(12) United States Patent
Puzio et al.

(10) Patent No.: US 7,982,095 B2
(45) Date of Patent: Jul. 19, 2011

(54) INCREASE IN YIELD BY REDUCING GENE EXPRESSION

(75) Inventors: Piotr Puzio, Berlin (DE); Agnes Chardonnens, NH Enkhuizen (NL)

(73) Assignee: Metanomics GmbH (DE)

( * ) Notice: Subject to any disclaimer, the term of this patent is extended or adjusted under 35 U.S.C. 154(b) by 695 days.

(21) Appl. No.: 11/791,706

(22) PCT Filed: Nov. 26, 2005

(86) PCT No.: PCT/EP2005/012650
§ 371 (c)(1),
(2), (4) Date: May 25, 2007

(87) PCT Pub. No.: WO2006/056468
PCT Pub. Date: Jun. 1, 2006

(65) Prior Publication Data
US 2008/0187646 A1    Aug. 7, 2008

(30) Foreign Application Priority Data

Nov. 27, 2004 (EP) .................................. 04028287

(51) Int. Cl.
*C12N 15/82*    (2006.01)
*C12N 15/90*    (2006.01)

(52) U.S. Cl. ..................................... 800/285; 800/290

(58) Field of Classification Search .................. None
See application file for complete search history.

(56) References Cited

U.S. PATENT DOCUMENTS
6,239,332 B1    5/2001    Ko et al.

FOREIGN PATENT DOCUMENTS

| EP | 1 033 405 A2 | 9/2000 |
|---|---|---|
| WO | WO-97/44471 A2 | 11/1997 |
| WO | WO-01/31041 A2 | 5/2001 |
| WO | WO-02/079403 A2 | 10/2002 |
| WO | WO-02/097101 A1 | 12/2002 |

OTHER PUBLICATIONS

Stacey et al., Plant Cell, 2002, vol. 14, pp. 2799-2811.*
Stacey et al., Planta, 2006, vol. 223, pp. 291-305.*
Osawa et al., Biochem. J., 2006, vol. 393, pp. 267-275.*
Klahre et al., PNAS, 2002, vol. 99, pp. 11981-11986.*
Thomas et al., Plant J., 2001, vol. 25, pp. 417-425.*
Terada et al., Nature Biotech., 2002, vol. 20, pp. 1030-1034.*
Giroux M.J., et al., "A Single Gene Mutation that Increases Maize Seed Weight", Proc. Nat'l. Acad. Sci. USA, (1996), vol. 93, No. 12, pp. 5824-5829.
Koh, S. et al., "An Oligopeptide Transporter Gene Family in *Arabidopsis*", Plant Physiology, (2002), vol. 128, No. 1, pp. 21-29.
Weber, H. et al., "Antisense-inhibition of ADP-glucose Pyrophosphorylase in Developing Seeds of *Vicia narbonensis* Moderately Decreases Starch but Increases Protein Content and Affects Seed Maturation", The Plant Journal, (2000), vol. 24, No. 1, pp. 33-43.
"*Arabidopsis thaliana* Genomic DNA, Chromosome 5, P1 clone:MSJ1", UniProt Database, Accession No. AB008268, Nov. 14, 1997.

* cited by examiner

*Primary Examiner* — Ashwin Mehta
(74) *Attorney, Agent, or Firm* — Connolly Bove Lodge & Hutz LLP

(57) ABSTRACT

The present invention relates to a process for the increase in yield in a plant organisms by reducing gene expression. The invention furthermore relates to nucleic acid molecules, polypeptides, nucleic acid constructs, vectors, antisense molecules, antibodies, host cells, plant tissue, propagation material, harvested material and plants.

11 Claims, 2 Drawing Sheets

Figure 1: Vector 1bxPcUbicolic
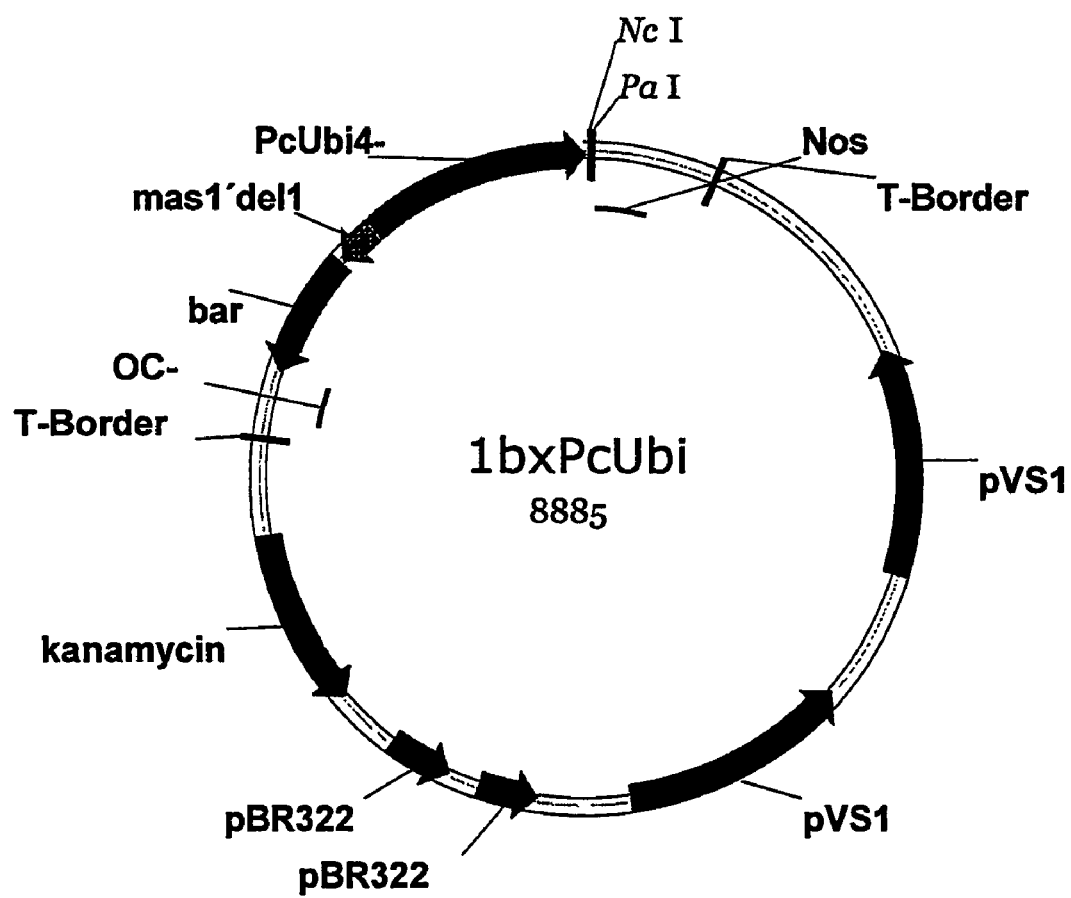

Figure. 2: 10xPcUbiSpacer
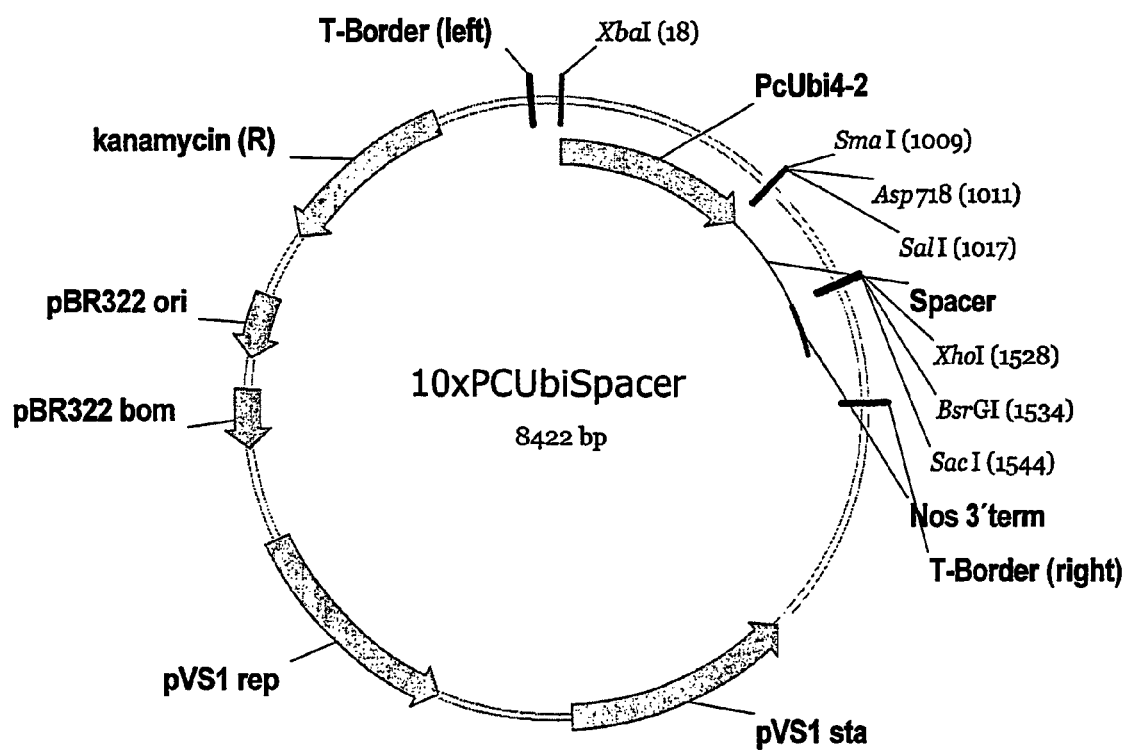

INCREASE IN YIELD BY REDUCING GENE EXPRESSION

SEQUENCE LISTING SUBMISSION

The Sequence Listing associated with this application is filed in electronic format via EFS-Web and hereby incorporated by reference into the specification in its entirety. The name of the text file containing the Sequence Listing is Second_Revised_Sequence_List_13195_00021_US. The size of the text file is 1,387 KB, and the text file was created on Mar. 23, 2010.

The present invention relates to a process for the increase in yield in plants by reduction or deletion of the biological activity represented by a protein as depicted in SEQ ID NO: 2, SEQ ID NO: 113 or its homologs and growing the plant under conditions which permit increased plant growth.

The invention furthermore relates to a nucleic acid molecule SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287
and a polypeptide SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 and nucleic acid constructs, vectors, antisense molecules, antibodies, host cells, plant tissue, propagation material, harvested material, plants as well as agricultural compositions and to their use.

Ever since useful plants were first cultivated, increasing the crop yield has, in addition to improving resistance to abiotic and biotic stress, been the most important aim when growing new plant varieties. Means as diverse as tilling, fertilizing, irrigation, cultivation or crop protection agents, to name but a few, are used for improving yields. Thus, cultivation successes in increasing the crop, for example by increasing the seed setting, and those in reducing the loss of crop, for example owing to bad weather, i.e. weather which is too dry, too wet, too hot or too cold, or due to infestation with pests such as, for example, insects, fungi or bacteria, complement one another. In view of the rapidly growing world population, a substantial increase in yield, without extending the economically arable areas, is absolutely necessary in order to provide sufficient food and, at the same time, protect other existing natural spaces.

The methods of classical genetics and cultivation for developing new varieties with better yields are increasingly supplemented by genetic methods. Thus, genes have been identified which are responsible for particular properties such as resistance to abiotic or biotic stress or growth rate control. Interesting genes or gene products thereof may be appropriately regulated in the desired useful plants, for example by mutation, (over)expression or reduction/inhibition of such genes or their products, in order to achieve the desired increased yield or higher tolerance to stress.

The same applies to microorganisms and useful animals, the breeding of which is primarily and especially concerned with likewise achieving a particular biomass or a particular weight more rapidly, in addition to higher resistance to biotic or abiotic stress.

One example of a strategy resulting in better or more rapid plant growth is to increase the photosynthetic capability of plants (U.S. Pat. No. 6,239,332 and DE 19940270). This approach, however, is promising only if the photosynthetic performance of said plants is growth-limiting. Another approach is to modulate regulation of plant growth by influencing cell cycle control (WO 01/31041, CA 2263067, WO 00/56905, WO 00/37645). However, a change in the plant's architecture may be the undesired side effect of a massive intervention in the control of plant growth (WO 01/31041; CA 2263067). Other approaches may involve putative transcriptional regulators as for example claimed in WO 02/079403 or US 2003/013228. Such transcriptional regulators often occur in gene families, in which the family members might display significant cross talk and/or antagonistic control. In addition the function of transcription factors rely on the precise presence of their recognition sequences in the target organisms. This fact might complicate the transfer of result from model species to target organisms.

Despite a few very promising approaches, there is nevertheless still a great need of providing methods for preparing organisms with faster growth and higher yield, especially by gene reduction methods, which do not involve the expression of a heterologous transgene.

BRIEF DESCRIPTION OF THE FIGURES

FIG. 1 depicts the vector 1bxPcUbicolic.
FIG. 2 depicts the vector 10xPcUbiSpacer.

DETAILED DESCRIPTION

It was now found that this object is achieved by providing the process according to the invention described herein and the embodiments characterized in the claims.

Accordingly, in a first embodiment, the invention relates to a process for the increase in seed yield and freshweight of plants. Accordingly, in the present invention, the term "yield" as used herein relates to "increase in fresh weight of seed or plant material".

In one embodiment, the term "yield" means dry matter of seed and plant material.

Accordingly, the invention relates to a process for the increase in yield, which comprises the following steps:
a) reduction or deletion of the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 in a plant, and
b) growing the plant under conditions which permit the increase in yield in said plant.

Advantageously a genetic modification of the plant leads to an enhanced yield of seed weight and/or fresh weight in the plant. The terms "enhanced" or "increase" mean at least a 5%, 10%, 15%, 20% or 25%, preferably at least 30%, 40%, 50%, 60% or 70%, more preferably 80%, 90%, 100%, 150% or 200% higher production in yield in comparison to the reference as defined below, that means in comparison to the plant without the aforementioned modification of the biological activity of protein of the invention.

Preferably, this process further includes the step of harvesting the seed, which is produced by the plant.

Surprisingly, the transgenic reduction or deletion of the expression of the protein of the invention in *Arabidopsis thaliana* conferred an increase in yield as measured as an increase in seed weight and fresh weight of the transformed plants.

In accordance with the invention, the term "plant" as understood herein relates to a monocot or a dicot plant, the whole plant, the seed, plant parts as tubers, roots, leaves or cell(s) thereof.

In accordance with the invention, a protein or polypeptide has the "activity or preferably biological activity" of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO:

220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 if in the event its de novo activity or biological activity is reduced or deleted leads to an increase in yield. That means the reduction or deletion of its biological activity for example its enzymatic activity is somehow related to the increase in yield. Throughout the specification the reduction or deletion of the bio logical activity of such a aforementioned protein or polypeptide or a nucleic acid mole cule or sequence encoding such protein or polypeptide means a reduction of its biological activity for example its enzymatic activity of at least 10% preferably 20%, 30%, 40% or 50%, particularly preferably 60% 70% or 80%, most particularly preferably 90%, 91%, 92%, 93%, 94%, 95%, 96%, 97%, 98%, 99% or 100% in comparison to the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288. Throughout the specification a deletion of the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 means a total loss of the activity. The reduction or deletion of the biological activity leads to an increase of the seed weight or the fresh weight of at least 10%, 20%, 30%, 40%, 50%, 100%, 150% or 200%, preferably of at least 250% or 300%, particularly preferably of at least 350% or 400%, most particularly preferably of at least 500% or 600% or more.

The terms "reduction", "decrease" or "deletion" relate to a corresponding change of a property in a plant, a plant part such as a tissue, seed, root, leaves, flower etc. or in a cell. Under "change of a property" it is understood that the activity, expression level or amount of a gene product or the metabolite content is changed in a specific volume or in a specific amount of protein relative to a corresponding volume or amount of protein of a control, reference or wild type. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "reduction", "decrease" or "deletion" include the change of said property in only parts of the subject of the present invention, for example, the modification can be found in compartment of a cell, like an organelle, or in a part of a plant, like tissue, seed, root, leaves, flowers etc. but is detectable if the overall subject, i.e. complete cell or plant, is tested. Preferably, the "reduction", "decrease" or "deletion" is found cellular, thus the term "reduction, decrease or deletion of an activity" or "reduction, decrease or deletion of a metabolite content" relates to the cellular reduction, decrease or deletion compared to the wild type cell. In addition the terms "reduction", "decrease" or "deletion" include the change of said property only during different growth phases of the organism used in the inventive process, for example the reduction, decrease or deletion takes place only during the seed growth or during blooming. Furthermore the terms include a transitional reduction, decrease or deletion for example because the used RNAi is not stable integrated in the genome of the organism and has therefore only a transient effect or is for example controlled by an inducible promoter.

Accordingly, the term "reduction", "decrease" or "deletion" means that the specific activity of an enzyme or a protein or regulatory RNA as well as the amount of a compound or metabolite, e.g. of a polypeptide, a nucleic acid molecule or the fine chemical of the invention or an encoding mRNA or DNA, can be reduced, decreased or deleted in a volume.

The terms "wild type", "control" or "reference" are exchangeable and can be a cell or a part of the plant such as an organelle or tissue, which was not modified or treated according to the herein described process according to the invention. Accordingly, the cell or a part of plant such as an organelle or a tissue, used as wild type, control or reference corresponds to the cell, organism or part thereof as much as possible and is in any other property but in the result of the process of the invention as identical to the subject matter of the invention as possible. Thus, the wild type, control or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control or wild type is in its genome, transcriptome, proteome or metabolome as similar as possible to the subject of the present invention. Preferably, the term "reference" "control-" or "wild type-"-organelle, -cell, -tissue or -plant relates to a plant which is nearly genetically identical to the organelle, cell, tissue or plant, of the present invention or a part thereof preferably 95%, more preferred are 98%, even more preferred are 99.00%, in particular 99.10%, 99.30%, 99.50%, 99.70%, 99.90%, 99.99%, 99, 999% or more. Most preferable the "reference", "control", or "wild type" is preferably a subject, e.g. an organelle, a cell, a tissue, an organism, which is genetically identical to the organism, cell organelle used according to the process of the invention except that nucleic acid molecules or the gene product encoded by them are changed according to the inventive process.

Preferably, the reference, control or wild type differs form the subject of the present invention only in the cellular activity of the polypeptide or RNA of the invention, e.g. as result of a reduction, decrease or deletion in the level of the nucleic acid molecule of the present invention or a reduction, decrease or deletion of the specific activity of the polypeptide or RNA of the invention, e.g. by the expression level or activity of protein or RNA that means its biological activity and/or its biochemical or genetic causes.

The term "expression" means the transcription of a gene into structural RNA (rRNA, tRNA, miRNA) or messenger RNA (mRNA) with the subsequent translation of the latter into a protein. Experimentally, expression can be detected by e.g. Northern, qRT PCR, transcriptional run-on assays or Western blotting and other immuno assays. As consequence of the reduction, decrease or deletion of the expression that means as consequence of the reduced, decreased or deleted transcription of a gene a related phenotypic trait appears such as the enhanced or increased production of the fine chemical.

Accordingly, preferred reference subject is the starting subject of the present process of the invention. Preferably, the reference and the subject matter of the invention are compared after standardization and normalization, e.g. to the amount of total RNA, DNA, or Protein or activity or expression of reference genes, like housekeeping genes, such as ubiquitin.

A series of mechanisms exists via which a modification in the polypeptide of the invention can directly or indirectly affect the yield, production and/or production efficiency of the amino acid. For example, the molecule number or the specific activity of the polypeptide of the invention or the number of expression of the nucleic acid molecule of the invention may be reduced, decreased or deleted. However, it is also possible to reduce, decrease or delete the expression of the gene which is naturally present in the organisms, for example by modifying the regulation of the gene, or by reducing or decreasing the stability of the mRNA or of the gene product encoded by the nucleic acid molecule of the invention.

This also applies analogously to the combined reduction, decrease or deletion of the expression of the nucleic acid molecule of the present invention or its gene product together with the manipulation of additional activities such as e.g. biosynthetic enzymes.

The reduction, decrease, deletion or modulation according to this invention can be constitutive, e.g. due to a stable permanent transgenic expression or to a stable mutation in the corresponding endogenous gene encoding the nucleic acid molecule of the invention or to a modulation of the expression or of the behaviour of a gene conferring the expression of the polypeptide of the invention, or transient, e.g. due to an transient transformation, a transiently active promotor or temporary addition of a modulator such as an antagonist or inductor, e.g. after transformation with a inducible construct carrying a double-stranded RNA nucleic acid molecule, an antisense nucleic acid molecule, a ribozyme of the invention etc. under control of a inducible promoter and adding the inducer, e.g. tetracycline or as described herein below.

The reduction, decrease or deletion in activity amounts preferably by at least 10%, preferably by at least 30% or at least 60%, especially preferably by at least 70%, 80%, 85%, 90% or more, very especially preferably are at least 95%, more preferably are at least 99% or more in comparison to the control, reference or wild type. Most preferably the reduction, decrease or deletion in activity amounts to 100%.

The specific activity of a polypeptide encoded by a nucleic acid molecule of the present invention or of the polypeptide of the present invention can be tested as described in the examples. In particular, the reduction, decrease or deletion of the expression of a protein in question in a cell, e.g. a plant cell or a microorganism and the detection of an increase of the fine chemical level as well as in comparison to a control is an easy test and can be performed as described in the examples.

The term "reduction", "decrease" or "deletion" includes, that the reason for said "reduction", "decrease" or "deletion" is a chemical compound, which is administered to the organism.

Accordingly, in the following, the term "reducing", "decreasing" or "deleting" also comprises the term "debasing", "depleting", diminishing" or "bringing down". The decreased or reduced activity manifests itself in increased yield. In this context, the yield, is increased by 3% or more, especially preferably are 10% or more, very especially preferably are more than 30% and most preferably are 70% or more, such as 100%, 300% or 500% or more.

A protein having a biological activity of the proteins used in the inventive process preferably has the structure of the polypeptide described herein, in particular of the polypeptides shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 232, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 or the functional homologues thereof as described herein, or is encoded by the nucleic acid molecule characterized herein or the nucleic acid molecule according to the invention, for example by the nucleic acid molecule shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285, SEQ ID NO: 287 or its herein described functional homologues and has the abovementioned activity.

For the purposes of the present invention, the terms "yield" also encompass the corresponding plant parts, such as, for example leaves, seed, roots or stem. Preferably the term yield is intended to encompass the term seed fresh weight, seed dry weight, plant fresh weight, plant dry weight, leaf number, leaf fresh weight, leaf dry weight, root fresh weight, root dry weight, number of blossoms, number of leaves, fruit fresh weight and fruit dry weight, blossom fresh weight, blossom dry weight.

The term "expression" refers to the transcription and/or translation of a codogenic gene segment or gene. As a rule, the resulting product is a mRNA or a protein. However, expression products can also include functional RNAs such as, for example, antisense, tRNAs, snRNAs, rRNAs, dsRNA, siRNA, miRNAs, ribozymes etc. Expression may be systemic, local or temporal, for example limited to certain cell types, tissues, organs or time periods.

In one embodiment, the process of the present invention comprises one or more of the following steps a) destabilizing a protein enabling the reduced, decreased or deleted expression of a protein encoded by the nucleic acid molecule of the invention or of the polypeptid of the invention, e.g. of a polypeptide having the biological activity of a protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 leading to the herein-mentioned yield increasing activity; or b) destabilizing a mRNA enabling the reduced, decreased or deleted expression of a protein encoded by the nucleic acid molecule of the invention, e.g. of a polypeptide having the biological activity of protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 or of a mRNA encoding the polypeptide of the present invention leading to the herein-mentioned yield increasing activity; or c) Increasing the biological activity of a protein or RNA e.g. increasing the biological activity of a repressor enabling the reduced, decreased or deleted expression of a protein encoded by the nucleic acid molecule of the invention or of the polypeptide of the present invention leading to the herein-mentioned yield increasing activity, e.g. of a polypeptide having the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 or increasing the inhibitory regulation of the polypeptide of the invention; or d) Increasing the biological activity of a protein or RNA e.g. increasing the biological activity of a repressor enabling the reduced, decreased or deleted expression of a protein encoded by the nucleic acid molecule of the present invention or a polypeptide of the present invention leading to the herein-mentioned yield increasing activity, e.g. of a polypeptide having the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 by adding one or more exogenous repression factors such as a chemical compound for example an inhibitor to the plant or parts thereof; or e) reducing, decreasing or deleting the copy number of a gene e.g. reducing, decreasing or deleting the copy number of a gene encoding an activator enabling the increased expression of a nucleic add molecule encoding a polypeptide encoded by the nucleic acid molecule of the invention or the polypeptide of the invention having herein-mentioned yield increasing activity, e.g. of a polypeptide having the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 by adding for example an antisense molecule or RNAi or improving the activity of negative expression elements. This can be achieved for example through the expression of the nucleic acids of the invention or parts of it in antisense orientation or by the expression of hairpin RNAi constructs or the simultaneous expression of sense and antisense RNA for the nucleic acids of the invention. Details are described later in the description or in the examples; or f) reducing, decreasing or deleting the expression of the endogenous gene encoding the polypeptide of the invention, e.g. a polypeptide having the biological activity of the protein used in the inventive process such as the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 or g) Increasing the biological activity of a protein or RNA leading to a dominant negative phenotype of the biological activity of the nucleic acid molecule of the invention or the protein of the invention such as a protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222; SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288. Advantageously this can be achieved for example through the expression of the nucleic acids encoding a protein, which has lost its biological activity and which binds to another protein in a multimeric complex and thereby decreasing or deleting the activity of said complex or which binds for example as a transcription factor to DNA and thereby decreasing or deleting the activity of the translated protein; or h) expression of an antibody or aptamer, which binds to the nucleic acid molecule of the invention or the protein of the invention such as a protein as depicted SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 and thereby reducing, decreasing or deleting its biological activity; and/or i) modulating growth conditions of an organism in such a manner, that the expression or activity of the nucleic acid molecule encoding the protein of the invention or the protein itself is reduced, decreased or deleted. This can be achieved by e.g. modulating light and/or nutrient conditions, which in terms modulated the expression of the gene or protein of the invention.

Preferably, said mRNA is one kind of the nucleic acid molecule of the present invention and/or the protein enabling the reduced or decreased expression of a protein encoded by the nucleic acid molecule of the present invention or the polypeptide having the herein mentioned biological activity of the polypeptide of the present invention, e.g. conferring the increase in yield after decreasing the expression or activity of the encoded polypeptide or having the biological activity of a polypeptide having the biological activity of the protein of the invention.

In general, the amount of mRNA, polynucleotide or nucleic acid molecule in a cell or a compartment of an organism correlates to the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and metabolite inhibitions of enzymes are well known.

The activity of the abovementioned protein and/or polypeptide encoded by the nucleic acid molecule of the present invention can be reduced, decreased or deleted in various ways. For example, the activity in an organism or in a part thereof, like a cell, is reduced or decreased via reducing or decreasing the gene product number, e.g. by reducing or decreasing the expression rate, like mutating the natural promoter to a lower activity, or by reducing or decreasing the stability of the mRNA expressed, thus reducing or decreasing the translation rate, and/or reducing or decreasing the stability of the gene product, thus increasing the proteins decay. Further, the activity or turnover of enzymes or channels or carriers, transcription factors, and similar active proteins can be influenced in such a manner that a reduction of the reaction rate or a modification (reduction, decrease or deletion) of the affinity to the substrate results, is reached. A mutation in the catalytic centre of an polypeptide of the invention, e.g. as enzyme, can modulate the turn over rate of the enzyme, e.g. a knock out of an essential amino acid can lead to a reduced or complete knock out of the activity of the enzyme, or the deletion of regulator binding sites can reduce a negative regulation like a feedback inhibition (or a substrate inhibition, if the substrate level is also increased). The specific activity of an transporter of the present invention can be decreased such that the transport rate is decreased. Reducing the stability of the encoding mRNA or the protein can also decrease the activity of a gene product. The reduction of the activity is also under the scope of the term "reduced, decreased or deleted activity". Beside this, advantageously the reduction of the activity in cis, e.g. mutating the promotor including other cis-regulatory elements, or the transcribed or coding parts of the gene, inhibition can be achieved in trans, e.g. by transfactors like chimeric transcription factor, ribozymes, antisense RNAs, dsRNAs antibodies or dominant negative proteins versions, which interfere with various stages of expression, e.g. the transcription, the translation or the activity of the protein or protein complex itself.

In the inventive process as mentioned above preferably the reduction, decrease or deletion of the biological activity represented by protein of the invention is achieved by reducing, decreasing or deleting the expression of at least one nucleic acid molecule, wherein the nucleic acid molecule is selected from the group consisting of:

a) nucleic acid molecule encoding the polypeptide shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

b) nucleic acid molecule comprising the nucleic acid molecule shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287;

c) nucleic acid molecule comprising a nucleic acid sequence, which, as a result of the degeneracy of the genetic code, can be derived from a polypeptide sequence depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

d) nucleic acid molecule encoding a polypeptide having at least 50% identity with the amino acid sequence of the polypeptide encoded by the nucleic acid molecule of (a) to (c) and having the biological activity represented by protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

e) nucleic acid molecule which comprises a polynucleotide which is obtained by amplifying a cDNA library or a genomic library using the primers depicted in SEQ ID NO:92 and SEQ ID NO: 93 or SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 264, SEQ ID NO: 265 and having the biological activity represented by proteins as depicted in SEQ ID NO: 2 or SEQ ID NO: 113;

f) nucleic acid molecule encoding a polypeptide which is isolated with the aid of monoclonal or polyclonal antibodies against a polypeptide encoded by one of the nucleic acid molecules of (a) to (d or e) and having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

g) nucleic acid molecule encoding a polypeptide comprising the consensus sequence shown in SEQ ID NO: 87 or SEQ ID NO: 88 or SEQ ID NO: 89 or SEQ ID NO: 90 or SEQ ID NO: 91 or SEQ ID NO: 265 or SEQ ID NO: 266 or SEQ ID NO: 267 or SEQ ID NO: 268 and having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO:

206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 28;

h) nucleic acid molecule encoding a polypeptide having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

i) nucleic acid molecule which is obtainable by screening a suitable nucleic acid library under stringent hybridisation conditions with a probe comprising one of the sequences of the nucleic acid molecule of (a) or (b) or with a fragment thereof having at least 15 nt, preferably 20 nt, 30 nt, 50 nt, 100 nt, 200 nt or 500 nt of the nucleic acid molecule characterized in (a) to (c) and encoding a polypeptide having the biological activity represented by protein of the invention or which comprises a sequence which is complementary thereto.

Moreover, the regulation of the abovementioned nucleic acid sequences may be modified so that gene expression is decreased. This reduction, decrease or deletion (reduction, decrease, deletion, inactivation or down-regulation shall be used as synonyms throughout the specification) can be achieved as mentioned above by all methods known to the skilled person, preferably by double-stranded RNA interference (dsRNAi), introduction of an antisense nucleic acid, a ribozyme, an antisense nucleic acid combined with a ribozyme, a nucleic acid encoding a co-suppressor, a nucleic acid encoding a dominant negative protein, DNA- or protein-binding factors targeting said gene or -RNA or -proteins, RNA degradation inducing viral nucleic acids and expression systems, systems for inducing a homologous recombination of said genes, mutations in said genes or a combination of the above.

In general, an activity of a gene product in a plant or part thereof, in particular in a plant cell or a plant tissue can be decreased by decreasing the amount of the specific encoding mRNA or the corresponding protein in said plant or part thereof. "amount of protein or mRNA" is understood as meaning the molecule number of polypeptides or mRNA molecules in a plant, a plant tissue, a plant cell or a cell compartment. "Decrease" in the amount of a protein means the quantitative decrease of the molecule number of said protein in a plant, a plant tissue, a plant cell or a cell compartment—for example by one of the methods described herein below—in comparison to a wild type, control or reference.

In this context, inactivation means that the enzymatic or biological activity of the polypeptides encoded is no longer detectable in the plant or in the plant cell. For the purposes of the invention, down regulation (=reduction) means that the enzymatic or biological activity of the polypeptides encoded is partly or completely reduced in comparison with the activity of the untreated plant. This can be achieved by different cell-biological mechanisms. In this context, the activity can be down regulated in the entire plant or in individual parts of the plant, for example in tissues such as the seed, the leaf, the root or other parts. In this context, the enzymatic activity or biological activity is reduced by at least 10%, advantageously at least 20%, preferably at least 30%, especially preferably at least 40%, 50% or 60%, very especially preferably at least 70%, 80%, 85% or 90% or more, very especially preferably are at least 95%, more preferably are at least 99% or more in comparison to the control, reference or wild type. Most preferably the reduction, decrease or deletion in activity amounts to 100%.

Various strategies for reducing the quantity, the expression, the activity or the function of proteins encoded by the nucleic acids or the nucleic acid sequences itself according to the invention are encompassed in accordance with the invention. The skilled worker will recognize that a series of different methods are available for influencing the quantity of a protein, the activity or the function in the desired manner.

The term "biological activity" means the biological function of the protein of the invention. In contrast to the term "biological activity" the term "activity" means the increase in yield produced by the inventive process. The term "biological activity" preferably refers to for example the enzymatic function, transporter or carrier function, DNA-packaging function, heat shock protein function, recombination protein function or regulatory function of a peptide or protein in a plant, a plant tissue, a plant cell or a cell compartment. Suitable substrates are low-molecular-weight compounds and also the protein interaction partners of a protein. The term "reduction" of the biological function refers, for example, to the quantitative reduction in binding capacity or binding strength of a protein for at least one substrate in a plant, a plant tissue, a plant cell or a cell compartment—for example by one of the methods described herein below—in comparison with the wild type of the same genus and species to which this method has not been applied, under otherwise identical conditions (such as, for example, culture conditions, age of the plants and the like). Reduction is also understood as meaning the modification of the substrate specificity as can be expressed for example, by the kcat/Km value. In this context, a reduction of the function of at least 10%, advantageously of at least 20%, preferably at least 30%, especially preferably of at least 40%, 50% or 60%, very especially preferably of at least 70%, 80%, 90% or 95%, in comparison with the untreated plant is advantageous. A particularly advantageous embodiment is the inactivation of the function, e.g. the function of a transporter membrane protein. Binding partners for the protein can be identified in the manner with which the skilled worker is familiar, for example by the yeast 2-hybrid system.

A modification, i.e. a decrease, can be caused by endogenous or exogenous factors. For example, a decrease in activity in a plant or a part thereof can be caused by adding a chemical compound such as an antagonist to the media, nutrition, soil of the plants or to the plants themselves.

In one embodiment the increase in yield can be achieved by decreasing the endogenous level of the polypeptide of the invention. Accordingly, in an embodiment of the present invention, the present invention relates to a process, wherein the gene copy number of a gene encoding the polynucleotide or nucleic acid molecule of the invention is decreased. Further, the endogenous level of the polypeptide of the invention can for example be decreased by modifying the transcriptional or translational regulation of the polypeptide.

A further embodiment of the inventive process is a process, whereby the reduction or deletion of the biological activity represented by the protein used in the inventive process is achieved by a process comprising a step selected from the group consisting of:

(a) introducing of a nucleic acid molecule encoding a ribonucleic acid sequence, which are able to form double-stranded ribonucleic acid molecules, whereby the sense strand of said double-stranded ribonucleic acid molecules has a homology of at least 30% to a nucleic acid molecule conferring the expression of or encoding a protein having the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 or comprising a fragment of at least 17, 18, 19, 20, 21, 22, 23, 24 or 25 base pairs of a nucleic acid molecule with a homology of at least 50% to a nucleic acid molecule conferring the expression of a protein having the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

(b) introducing an antisense nucleic acid molecule, whereby the antisense nucleic acid molecule has a homology of at least 30% to a nucleic acid molecule antisense to a nucleic acid molecule encoding a protein having the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288; or conferring the expression of a protein having the biological activity of a protein having the biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288; or introducing an antisense nucleic acid molecule comprising a fragment of at least 15, 16, 17, 18, 19, 20, 21, 22, 23, 24 or 25 base pairs of a nucleic acid molecule with a homology of at least 50% to an antisense nucleic acid molecule to a nucleic acid molecule conferring the expression of a protein having the biological activity of protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

(c) introducing of a ribozyme which specifically cleaves a nucleic acid molecule conferring expression of a protein having the biological activity of protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

(d) introducing of the antisense nucleic acid molecule characterized in (b) or the ribozyme characterized in (c);

(e) introducing of a sense nucleic acid molecule conferring the expression of a nucleic acid molecule as depicted in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83 or SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or a nucleic acid molecule encoding a polypeptide or part of it (need not to encode a functional protein) having at least 50% identity with the amino acid sequence of the polypeptide encoded by the nucleic acid molecule of used in the inventive process and having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 for inducing a cosuppression of the endogenous protein having a biological activity of the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

(f) introducing a nucleic acid molecule conferring the expression of a dominant-negative mutant of a protein having the biological activity of a protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ. ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 that means by expressing said sequence leading to the dominant-negative mutant protein thereby the biological activity of the protein used in the inventive process is reduced, decreased or deleted and therefore the yield is increased;

(g) introducing a nucleic acid molecule encoding a factor, which binds to a nucleic acid molecule conferring the expression of a protein having the biological activity of a protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

(i) introducing a nucleic acid construct capable to recombine with a endogenous gene conferring the expression of a protein having the biological activity of a protein used in the inventive process especially a protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

(j) introducing a non-silent mutation in an endogenous gene conferring the expression of a protein having the biological activity of a protein used in the inventive process especially a protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

(k) selecting of a non-silent mutation in a nucleic acid sequence encoding a protein having the biological activity of a protein used in the inventive process especially a protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID, NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO:

222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 from a randomly mutagenized population of organisms used in the inventive process; and/or (l) introducing an expression construct conferring the expression of nucleic acid molecule characterized in any one of (a) to (k).

As the skilled person knows it is possible starting from the nucleic acid sequences mentioned under point (a) to (j) above it is easy possible to isolate the 5'- and/or 3'-regions of said nucleic acid sequences and to use said 5'- and/or 3'-sequences for the reduction, decrease or deletion of the nucleic acid sequences used in the inventive process according to the different process steps (a) to (j) mentioned above. Preferably less than 1000 bp, 900 bp, 800 bp or 700 bp, particular preferably less than 600 bp, 500 bp, 400 bp, 300 bp, 200 bp or 100 bp of the 5'- and/or 3'-region of the said nucleic acid sequence are used.

The aforementioned process steps of the reduction or deletion of the biological activity represented by the protein of the invention lead to an increase in yield.

A reduction in the activity or the function is preferably achieved by a reduced expression of a gene encoding the protein of the inventive process.

Further preferred embodiments of the invention to reduce the biological activity of the protein of the inventive process, said reduction of the activity or function can be achieved using the following methods:

a) introduction of a double-stranded RNA nucleic acid sequence (dsRNA) as described above or of an expression cassette, or more than one expression cassette, ensuring the expression of the latter;

b) introduction of an antisense nucleic acid sequence or of an expression cassette ensuring the expression of the latter. Encompassed are those methods in which the antisense nucleic acid sequence is directed against a gene (i.e. genomic DNA sequences) or a gene transcript (i.e. RNA sequences) including the 5' and 3' non-translated regions. Also encompassed are α-anomeric nucleic acid sequences;

c) introduction of an antisense nucleic acid sequence in combination with a ribozyme or of an expression cassette ensuring the expression of the former;

d) introduction of sense nucleic acid sequences for inducing cosuppression or of an expression cassette ensuring the expression of the former;

e) introduction of a nucleic acid sequence encoding dominant-negative protein or of an expression cassette ensuring the expression of the latter, f) introduction of DNA-, RNA- or protein-binding factors against genes, RNA's or proteins or of an expression cassette ensuring the expression of the latter;

g) introduction of viral nucleic acid sequences and expression constructs which bring about the degradation of RNA, or of an expression cassette ensuring the expression of the former;

h) introduction of constructs for inducing homologous recombination on endogenous genes, for example for generating knockout mutants;

i) introduction of mutations into endogenous genes for generating a loss of function (e.g. generation of stop codons, reading-frame shifts and the like); and/or j) identifying a non silent mutation e.g. generation of stop codons, reading-frame shifts, inversions and the like in random mutagenized population according to the so called tilling method.

k) introduction of constructs for expression of an antibody which specifically binds and thereby inactivates the polypeptides of the invention.

Each of these methods may bring about a reduction in the expression, the activity or the function for the purposes of the invention. A combined use is also feasible. Further methods are known to the skilled worker and may encompass hindering or preventing processing of the protein, transport of the protein or its mRNA, inhibition of ribosomal attachment, inhibition of RNA splicing, induction of an enzyme which degrades RNA or the protein of the invention and/or inhibition of translational elongation or termination.

What follows is a brief description of the individual preferred methods:

A) Introduction of a Double-Stranded RNA Nucleic Acid Sequence (dsRNA)

The method of regulating genes by means of double-stranded RNA ("double-stranded RNA interference"; dsRNAi) has been described extensively for animal, yeast fungi and plant organisms such as *Neurospora*, Zebrafish, *Drosophila*, mice, planaria, humans, *Trypanosoma*; petunia or *Arabidopsis* (for example Matzke M A et al. (2000) Plant Mol. Biol. 43: 401-415; Fire A. et al. (1998) Nature 391: 806-811; WO 99/32619; WO 99/53050; WO 00/68374; WO 00/44914; WO 00/44895; WO 00/49035; WO 00/63364). In addition RNAi is also documented as an advantageously tool for the repression of genes in bacteria such as *E. coli* for example by Tchurikov et al. [J. Biol. Chem., 2000, 275 (34): 26523-26529]. Fire et al. named the phenomenon RNAi for RNA interference. The techniques and methods described in the above references are expressly referred to. Efficient gene suppression can also be observed in the case of transient expression or following transient transformation, for example as the consequence of a biolistic transformation (Schweizer P et al. (2000) Plant J 2000 24: 895-903). dsRNAi methods are based on the phenomenon that the simultaneous introduction of complementary strand and counterstrand of a gene transcript brings about highly effective suppression of the expression of the gene in question. The resulting phenotype is very similar to that of an analogous knock-out mutant (Waterhouse P M et al. (1998) Proc. Natl. Acad. Sci. USA 95: 13959-64).

Tuschl et al. [Gens Dev., 1999, 13 (24): 3191-3197] was able to show that the efficiency of the RNAi method is a function of the length of the duplex, the length of the 3'-end overhangs, and the sequence in these overhangs. Based on the work of Tuschl et al. and assuming that the underlining principles are conserved between different species the following guidelines can be given to the skilled worker:

to achieve good results the 5' and 3' untranslated regions of the used nucleic acid sequence and regions close to the start codon should be in general avoided as this regions are richer in regulatory protein binding sites and interactions between RNAi sequences and such regulatory proteins might lead to undesired interactions;

in plants the 5' and 3' untranslated regions of the used nucleic acid sequence and regions close to the start codon preferably 50 to 100 nt upstream of the start codon give good results and therefore should not be avoided;

preferably a region of the used mRNA is selected, which is 50 to 100 nt (=nucleotides or bases) downstream of the AUG start codon;

only dsRNA (=double-stranded RNA) sequences from exons are useful for the method, as sequences from introns have no effect;

the G/C content in this region should be greater than 30% and less than 70% ideally around 50%;

a possible secondary structure of the target mRNA is less important for the effect of the RNAi method.

The dsRNAi method has proved to be particularly effective and advantageous for reducing the expression of the nucleic acid sequences of the SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 and/or homologs thereof. As described inter alia in WO 99/32619, dsRNAi approaches are clearly superior to traditional antisense approaches.

The invention therefore furthermore relates to double-stranded RNA molecules (dsRNA molecules) which, when introduced into an organism, advantageously into a plant (or a cell, tissue, organ or seed derived therefrom), bring about increased yield activity by the reduction in the expression of the nucleic acid sequences of the SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 and/or homologs thereof. In a double-stranded RNA molecule for reducing the expression of an protein encoded by a nucleic acid sequence of one of the SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 and/or homologs thereof, i) one of the two RNA strands is essentially identical to at least part of a nucleic acid sequence, and
ii) the respective other RNA strand is essentially identical to at least part of the complementary strand of a nucleic acid sequence.

The term "essentially identical" refers to the fact that the dsRNA sequence may also include insertions, deletions and individual point mutations in comparison to the target sequence while still bringing about an effective reduction in expression. Preferably, the homology as defined above amounts to at least 30%, preferably at least 40%, 50%, 60%, 70% or 80%, very especially preferably at least 90%, most preferably 100%, between the "sense" strand of an inhibitory dsRNA and a part-segment of a nucleic acid sequence of the invention including in a preferred embodiment of the invention their endogenous 5'- and 3' untranslated regions or between the "antisense" strand and the complementary strand of a nucleic acid sequence, respectively. The part-segment amounts to at least 10 bases, preferably at least 17, 18, 19, 20, 21, 22, 23, 24, 25, 26, 27, 28, 29 or 30 bases, especially preferably at least 40, 50, 60, 70, 80 or 90 bases, very especially preferably at least 100, 200, 300 or 400 bases, most preferably at least 500, 600, 700, 800, 900 or more bases or at least 1000 or 2000 bases or more in length. In another preferred embodiment of the invention the part-segment amounts to 17, 18, 19, 20, 21, 22, 23, 24, 25, 26 or 27 bases, preferably to 20, 21, 22, 23, 24 or 25 bases. These short sequences are preferred in plants. The longer sequences preferably between 200 and 800 bases are also useable in plants. Long double-stranded RNAs are processed in the plant into many siRNAs (=small/short interfering RNAs) for example by the protein Dicer, which is a ds-specific Rnase III enzyme. As an alternative, an "essentially identical" dsRNA may also be defined as a nucleic acid sequence, which is capable of hybridizing with part of a gene transcript (for example in 400 mM NaCl, 40 mM PIPES pH 6.4, 1 mM EDTA at 50° C. or 70° C. for 12 to 16 h).

The dsRNA may consist of one or more strands of polymerized ribonucleotides. Modification of both the sugar-phosphate backbone and of the nucleosides may furthermore be present. For example, the phosphodiester bonds of the natural RNA can be modified in such a way that they encompass at least one nitrogen or sulfur heteroatom. Bases may undergo modification in such a way that the activity of, for example, adenosine deaminase is restricted. These and other modifications are described herein below in the methods for stabilizing antisense RNA.

The dsRNA can be prepared enzymatically; it may also be synthesized chemically, either in full or in part. Short dsRNA up to 30 bp, which effectively mediate RNA interference, can be for example efficiently generated by partial digestion of long dsRNA templates using E. coli ribonuclease III (RNase III). (Yang, D., et al. (2002) Proc. Natl. Acad. Sci. USA 99, 9942.)

The double-stranded structure can be formed starting from a single, self-complementary strand or starting from two complementary strands. In a single, self-complementary strand, "sense" and "antisense" sequence can be linked by a linking sequence ("linker") and form for example a hairpin structure. Preferably, the linking sequence may take the form of an intron, which is spliced out following dsRNA synthesis. The nucleic acid sequence encoding a dsRNA may contain further elements such as, for example, transcription termination signals or polyadenylation signals. If the two strands of the dsRNA are to be combined in a cell or a plant, this can be brought about in a variety of ways:

a) transformation of the cell or of the plant, with a vector encompassing the two expression cassettes;
b) cotransformation of the cell or of the plant, with two vectors, one of which encompasses the expression cassettes with the "sense" strand while the other encompasses the expression cassettes with the "antisense" strand;
c) supertransformation of the cell or of the plant, with a vector encompassing the expression cassettes with the "sense" strand, after the cell or the plant had already been transformed with a vector encompassing the expression cassettes with the "antisense" strand;
d) hybridization e.g. crossing of two organisms, advantageously of plants, each of which has been transformed with one vector, one of which encompasses the expression cassettes with the "sense" strand while the other encompasses the expression cassettes with the "antisense" strand;
e) introduction of a construct comprising two promoters that lead to transcription of the desired sequence from both directions; and/or
f) infecting of the cell or of the plant with an engineered virus, which is able to produce the desired dsRNA molecule.

Formation of the RNA duplex can be initiated either outside the cell or within the cell. If the dsRNA is synthesized outside the target cell or plant it can be introduced into the plant or a cell of the plant by injection, microinjection, electroporation, high velocity particles, by laser beam or mediated by chemical compounds (DEAE-dextran, calcium-phosphate, liposomes).

As shown in WO 99/53050, the dsRNA may also encompass a hairpin structure, by linking the "sense" and "antisense" strands by a "linker" (for example an intron). The self-complementary dsRNA structures are preferred since they merely require the expression of a construct and always encompass the complementary strands in an equimolar ratio.

The expression cassettes encoding the "antisense" or the "sense" strand of the dsRNA or the self-complementary strand of the dsRNA are preferably inserted into a vector and stably inserted into the genome of a plant, using the methods described herein below (for example using selection markers), in order to ensure permanent expression of the dsRNA. Transient expression with bacterial or viral vectors are similar useful.

The dsRNA can be introduced using an amount which makes possible at least one copy per cell. A larger amount (for example at least 5, 10, 100, 500 or 1 000 copies per cell) may bring about more efficient reduction.

As has already been described, 100% sequence identity between the dsRNA and a gene transcript of a nucleic acid sequence of one of the SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or its homolog is not necessarily required in order to bring about effective reduction in the expression. The advantage is, accordingly, that the method is tolerant with regard to sequence deviations as may be present as a consequence of genetic mutations, polymorphisms or evolutionary divergences. Thus, for example, using the dsRNA, which has been generated starting from a sequence of one of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or homologs thereof of one plant, may be used to suppress the corresponding expression in another plant.

Due to the high degree of sequence homology between SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111 and SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 respectively from various organisms (e.g. plants), allows the conclusion that these proteins may be conserved to a high degree within, for example other plants, it is optionally possible so that the expression of a dsRNA derived from one of the disclosed sequences as shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or homologs thereof should also have an advantageous effect in other plant species.

The dsRNA can be synthesized either in vivo or in vitro. To this end, a DNA sequence encoding a dsRNA can be introduced into an expression cassette under the control of at least one genetic control element (such as, for example, promoter, enhancer, silencer, splice donor or splice acceptor or polyadenylation signal). Suitable advantageous constructs are described herein below. Polyadenylation is not required, nor do elements for initiating translation have to be present A dsRNA can be synthesized chemically or enzymatically. Cellular RNA polymerases or bacteriophage RNA polymerases (such as, for example T3, T7 or SP6 RNA polymerase) can be used for this purpose. Suitable methods for the in-vitro expression of RNA are described (WO 97/32016; U.S. Pat. No. 5,593,874; U.S. Pat. No. 5,698,425, U.S. Pat. No. 5,712,135, U.S. Pat. No. 5,789,214, U.S. Pat. No. 5,804, 693). Prior to introduction into a cell, tissue or organism, a dsRNA which has been synthesized in vitro either chemically or enzymatically can be isolated to a higher or lesser degree from the reaction mixture, for example by extraction, precipitation, electrophoresis, chromatography or combinations of these methods. The dsRNA can be introduced directly into the cell or else be applied extracellularly (for example into the interstitial space). In one embodiment of the invention the RNAi method leads to only a partial loss of gene function and therefore enables the skilled worker to study a gene dose effect in the desired plant and to fine tune the process of the invention. In another preferred embodiment it leads to a total loss of function and therefore increases the production of the fine chemical. Furthermore it enables a person skilled in the art to study multiple functions of a gene.

Stable transformation of the plant with an expression construct, which brings about the expression of the dsRNA is preferred, however. Suitable methods are described herein below.

B) Introduction of an Antisense Nucleic Acid Sequence

Methods for suppressing a specific protein by preventing the accumulation of its mRNA by means of "antisense" technology can be used widely and has been described extensively, including for plants [Sheehy et al. (1988) Proc. Natl. Acad. Sci. USA 85: 8805-8809; U.S. Pat. No. 4,801,34100; Mol J N et al. (1990) FEBS Lett 268(2): 427-430]. The antisense nucleic acid molecule hybridizes with, or binds to, the cellular mRNA and/or the genomic DNA encoding the target protein to be suppressed. This process suppresses the transcription and/or translation of the target protein. Hybridization can be brought about in the conventional manner via the formation of a stable duplex or, in the case of genomic DNA, by the antisense nucleic acid molecule binding to the duplex of the genomic DNA by specific interaction in the large groove of the DNA helix.

An "antisense" nucleic acid molecule comprises a nucleotide sequence, which is at least in part complementary to a "sense" nucleic acid molecule encoding a protein, e.g., complementary to the coding strand of a double-stranded cDNA molecule or complementary to an encoding mRNA sequence. Accordingly, an antisense nucleic acid molecule can bind via hydrogen bonds to a sense nucleic acid molecule. The antisense nucleic acid molecule can be complementary to an entire coding strand of a nucleic acid molecule conferring the expression of the polypeptide of the invention or to only a portion thereof. Accordingly, an antisense nucleic acid molecule can be antisense to a "coding region" of the coding strand of a nucleotide sequence of a nucleic acid molecule of the present invention. Advantageously the noncoding region is in the area of 50 bp, 100 bp, 200 bp or 300 bp, preferably 400 bp, 500 bp, 600 bp, 700 bp, 800 bp, 900 bp or 1000 bp up- and/or downstream from the coding region. The term "coding region" refers to the region of the nucleotide sequence comprising codons, which are translated into amino acid residues. Further, the antisense nucleic acid molecule is antisense to a "noncoding region" of the mRNA flanking the coding region of a nucleotide sequence. The term "noncoding region" refers to 5' and 3' sequences which flank the coding region that are not translated into a polypeptide, i.e., also referred to as 5' and 3' untranslated regions (5'-UTR or 3'-UTR).

Given the coding strand sequences encoding the polypeptide of the present invention, e.g. having above mentioned activity, e.g. the activity of a polypeptide with the biological activity of the protein of the invention as disclosed herein, antisense nucleic acid molecules of the invention can be designed according to the rules of Watson and Crick base pairing.

An antisense nucleic acid sequence which is suitable for reducing the activity of a protein can be deduced using the nucleic acid sequence encoding this protein, for example the nucleic acid sequence as shown in SEQ ID NO: 1, SEQ ID NO: 3, SEQ ID NO: 5, SEQ ID NO: 7, SEQ ID NO: 9, SEQ ID NO: 1, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 (or homologs, analogs, paralogs, orthologs thereof), by applying the base-pair rules of Watson and Crick. The antisense nucleic acid sequence can be complementary to all of the transcribed mRNA of the protein; it may be limited to the coding region, or it may only consist of one oligonucleotide, which is complementary to part of the coding or noncoding sequence of the mRNA. Thus, for example, the oligonucleotide can be complementary to the nucleic acid region, which encompasses the translation start for the protein. Antisense nucleic acid sequences may have an advantageous length of, for example, 5, 10, 15, 20, 25, 30, 35, 40, 45 or 50 nucleotides but they may also be longer and encompass at least 100, 200, 500, 1000, 2000 or 5000 nucleotides. A particular preferred length is between 15 and 30 nucleotides such as 15, 20, 25 or 30 nucleotides. Antisense nucleic acid sequences can be expressed recombinantly or synthesized chemically or enzymatically using methods known to the skilled worker. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of substances which can be used are phosphorothioate derivatives and acridine-substituted nucleotides such as 5-fluorouracil, 5-bromouracil, 5-chlorouracil, 5-iodouracil, hypoxanthine, xanthin, 4-acetylcytosine, 5-(carboxyhydroxymethyl)uracil, 5-carboxymethylaminomethyl-2-thiouridine, 5-carboxymethylaminomethyluracil, dihydrouracil, β-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, β-D-mannosylqueosine, 5'-methoxycarboxymethyluracil, 5-methoxyuracil, 2-methylthio-N6-isopentenyladenine, uracil-5-oxyacetic acid, pseudouracil, queosine, 2-thiocytosine, 5-methyl-2-thiouracil, 2-thiouracil, 4-thiouracil, 5-methyluracil, methyl uracil-5-oxyacetate, uracil-5-oxyacetic acid, 5-methyl-2-thiouracil, 3-(3-amino-3-N-2-carboxypropyl)uracil and 2,6-diaminopurine. Alternatively, the antisense nucleic acid can be produced biologically using an expression vector into which a nucleic acid molecule has been subcloned in an antisense orientation (i.e., RNA transcribed from the inserted nucleic acid molecule will be of an antisense orientation to a target nucleic acid molecule of interest, described further in the following subsection).

In a further preferred embodiment, the expression of a protein encoded by one of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 or homologs, analogs, paralogs, orthologs thereof can be inhibited by nucleotide sequences which are complementary to the regulatory region of a gene (for example a promoter and/or enhancer) and which may form triplex structures with the DNA double helix in this region so that the transcription of the gene is reduced. Such methods have been described (Helene C (1991) Anticancer Drug Res. 6(6): 569-84; Helene C et al. (1992) Ann. NY Acad. Sci. 660: 27-36; Maher L J (1992) Bioassays 14(12): 807-815).

In a further embodiment, the antisense nucleic acid molecule can be an α-anomeric nucleic acid. Such α-anomeric nucleic acid molecules form specific double-stranded hybrids with complementary RNA in which—as opposed to the conventional β-nucleic acids—the two strands run in parallel with one another (Gautier C et al. (1987) Nucleic Acids Res. 15: 6625-6641). Furthermore, the antisense nucleic acid molecule can also comprise 2'-O-methylribonucleotides [Inoue et al. (1987) Nucleic Acids Res. 15: 6131-6148] or chimeric RNA-DNA analogs [Inoue et al. (1987) FEBS Lett 215: 327-330].

The antisense nucleic acid molecules of the invention are typically administered to a cell or generated in situ such that they hybridize with or bind to cellular mRNA and/or genomic DNA encoding a polypeptide having the biological activity of protein of the invention thereby inhibit expression of the protein, e.g., by inhibiting transcription and/or translation and leading to the aforementioned yield increasing activity.

The antisense molecule of the present invention comprises also a nucleic acid molecule comprising a nucleotide sequences complementary to the regulatory region of an nucleotide sequence encoding the natural occurring polypeptide of the invention, e.g. the polypeptide sequences shown in the sequence listing, or identified according to the methods described herein, e.g., its promoter and/or enhancers, e.g. to form triple helical structures that prevent transcription of the gene in target cells. See generally, Helene, C. (1991) *Anticancer Drug Des.* 6(6):569-84; Helene, C. et al. (1992) *Ann. N.Y. Acad. Sci.* 660:27-36; and Maher, L. J. (1992) *Bioassays* 14(12):807-15.

C) Introduction of an Antisense Nucleic Acid Sequence Combined with a Ribozyme

It is advantageous to combine the above-described antisense strategy with a ribozyme method. Catalytic RNA molecules or ribozymes can be adapted to any target RNA and cleave the phosphodiester backbone at specific positions, thus functionally deactivating the target RNA (Tanner N K (1999) FEMS Microbiol. Rev. 23(3): 257-275). The ribozyme per se is not modified thereby, but is capable of cleaving further target RNA molecules in an analogous manner, thus acquiring the properties of an enzyme. The incorporation of ribozyme sequences into "antisense" RNAs imparts this enzyme-like RNA-cleaving property to precisely these "antisense" RNAs and thus increases their efficiency when inactivating the target RNA. The preparation and the use of suitable ribozyme "antisense" RNA molecules is described, for example, by Haseloff et al. (1988) Nature 33410: 585-591.

Further the antisense nucleic acid molecule of the invention can be also a ribozyme. Ribozymes are catalytic RNA molecules with ribonuclease activity, which are capable of cleaving a single-stranded nucleic acid, such as an mRNA, to which they have a complementary region. In this manner, ribozymes [for example "Hammerhead" ribozymes; Haselhoff and Gerlach (1988) Nature 33410: 585-591] can be used to catalytically cleave the mRNA of an enzyme to be suppressed and to prevent translation. The ribozyme technology can increase the efficacy of an antisense strategy. Methods for expressing ribozymes for reducing specific proteins are described in (EP 0 291 533, EP 0 321 201, EP 0 360 257). Ribozyme expression has also been described for plant cells (Steinecke P et al. (1992) EMBO J 11(4): 1525-1530; de Feyter R et al. (1996) Mol. Gen. Genet. 250(3): 329-338). Suitable target sequences and ribozymes can be identified for example as described by Steinecke P, Ribozymes, Methods in Cell Biology 50, Galbraith et al. eds, Academic Press, Inc. (1995), pp. 449-460 by calculating the secondary structures of ribozyme RNA and target RNA and by their interaction [Bayley C C et al. (1992) Plant Mol. Biol. 18(2): 353-361; Lloyd A M and Davis R W et al. (1994) Mol. Gen. Genet. 242(6): 653-657]. For example, derivatives of the tetrahymena L-19 IVS RNA, which have complementary regions to the mRNA of the protein to be suppressed can be constructed (see also U.S. Pat. No. 4,987,071 and U.S. Pat. No. 5,116,742). As an alternative, such ribozymes can also be identified from a library of a variety of ribozymes via a selection process (Bartel D and Szostak J W (1993) Science 261: 1411-1418).

D) Introduction of a (Sense) Nucleic Acid Sequence for Inducing Cosuppression

The expression of a nucleic acid sequence in sense orientation can lead to cosuppression of the corresponding homologous, endogenous genes. The expression of sense RNA with homology to an endogenous gene can reduce or indeed eliminate the expression of the endogenous gene, in a similar manner as has been described for the following antisense approaches: Jorgensen et al. [(1996) Plant Mol. Biol. 31(5): 957-973], Goring et al. [(1991) Proc. Natl. Acad. Sci. USA 88: 1770-1774], Smith et al. [(1990) Mol. Gen. Genet. 224: 447-481], Napoli et al. [(1990) Plant Cell 2: 279-289] or Van der Krol et al. [(1990) Plant Cell 2: 291-99]. In this context, the construct introduced may represent the homologous gene to be reduced either in full or only in part. The application of this technique to plants has been described for example by Napoli et al. [(1990) The Plant Cell 2: 279-289 and in U.S. Pat. No. 5,034,323]. Furthermore the above described cosuppression strategy can advantageously be combined with the RNAi method as described by Brummell et al., 2003, Plant J. 33, pp 793-800.

E) Introduction of Nucleic Acid Sequences Encoding a Dominant-Negative Protein

The function or activity of a protein can efficiently also be reduced by expressing a dominant-negative variant of said protein. The skilled worker is familiar with methods for reducing the function or activity of a protein by means of coexpression of its dominant-negative form [Lagna G and Hemmati-Brivanlou A (1998) Current Topics in Developmental Biology 36: 75-98; Perlmutter R M and Alberola-Ila J (1996) Current Opinion in Immunology 8(2): 285-90; Sheppard D (1994) American Journal of Respiratory Cell & Molecular Biology 11 (1): 1-6; Herskowitz I (1987) Nature 329 (6136): 219-22].

A dominant-negative variant can be realized for example by changing of an amino acid in the proteins encoded by one of SEQ ID NO: 2 or homologs thereof. This change can be determined for example by computer-aided comparison ("alignment"). These mutations for achieving a dominant-negative variant are preferably carried out at the level of the nucleic acid sequences. A corresponding mutation can be performed for example by PCR-mediated in-vitro mutagenesis using suitable oligonucleotide primers by means of which the desired mutation is introduced. To this end, methods are used with which the skilled worker is familiar. For example, the "LA PCR in vitro Mutagenesis Kit" (Takara Shuzo, Kyoto) can be used for this purpose. It is also possible and known to those skilled in the art that deleting or changing of functional domains, e.g. TF or other signaling components which can bind but not activate may achieve the reduction of protein activity.

F) Introduction of DNA- or Protein-Binding Factors Against Genes, RNAs or Proteins A reduction in the expression of a gene encoded by one of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO:

247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or homologs thereof according to the invention can also be achieved with specific DNA-binding factors, for example factors of the zinc finger transcription factor type. These factors attach to the genomic sequence of the endogenous target gene, preferably in the regulatory regions, and bring about repression of the endogenous gene. The use of such a method makes possible the reduction in the expression of an endogenous gene without it being necessary to recombinantly manipulate the sequence of the latter. Such methods for the preparation of relevant factors are described in Dreier B et al. [(2001) J. Biol. Chem. 276(31): 29466-78 and (2000) J. Mol. Biol. 303(4): 489-502], Beerli R R et al. [(1998) Proc. Natl. Acad. Sci. USA 95(25): 14628-14633; (2000) Proc. Natl. Acad. Sci. USA 97(4): 1495-1500 and (2000) J. Biol. Chem. 275(42): 32617-32627)], Segal D J and Barbas C F [3rd (2000) Curr. Opin. Chem. Biol. 4(1): 3410-39], Kang J S and Kim J S [(2000) J. Biol. Chem. 275(12): 8742-8748], Kim J S et al. [(1997) Proc. Natl. Acad. Sci. USA 94(8): 3616-3620], Klug A [(1999) J. Mol. Biol. 293(2): 215-218], Tsai S Y et al. [(1998) Adv. Drug Deliv. Rev. 30(1-3): 23-31], Mapp A K et al. [(2000) Proc. Natl. Acad. Sci. USA 97(8): 3930-3935], Sharrocks A D et al. [(1997) Int. J. Biochem. Cell Biol. 29(12): 1371-1387] and Zhang L et al. [(2000) J. Biol. Chem. 275(43): 33850-33860]. Examples for the application of this technology in plants have been described in WO 01/52620, Ordiz M I et al., (Proc. Natl. Acad. Sci. USA, Vol. 99, Issue 20, 13290-13295, 2002) or Guan et al., (Proc. Natl. Acad. Sci. USA, Vol. 99, Issue 20, 13296-13301, 2002)

These factors can be selected using any portion of a gene. This segment is preferably located in the promoter region. For the purposes of gene suppression, however, it may also be located in the region of the coding exons or introns. The skilled worker can obtain the relevant segments from Genbank by database search or starting from a cDNA whose gene is not present in Genbank by screening a genomic library for corresponding genomic clones.

It is also possible to first identify sequences in a target crop, which are encoded by one of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or homologs thereof, then find the promoter and reduce expression by the use of the abovementioned factors.

The skilled worker is familiar with the methods required for doing so.

Furthermore, factors which are introduced into a cell may also be those which themselves inhibit the target protein. The protein-binding factors can, for example, be aptamers [Famulok M and Mayer G (1999) Curr. Top Microbiol. Immunol. 243: 123-36] or antibodies or antibody fragments or single-chain antibodies. Obtaining these factors has been described, and the skilled worker is familiar therewith. For example, a cytoplasmic scFv antibody has been employed for modulating activity of the phytochrome A protein in genetically modified tobacco plants [Owen M et al. (1992) Biotechnology (NY) 10(7): 790-794; Franken E et al. (1997) Curr. Opin. Biotechnol. 8(4): 411-416; Whitelam (1996) Trend Plant Sci. 1: 286-272].

Gene expression may also be suppressed by tailor-made low-molecular-weight synthetic compounds, for example of the polyamide type [Dervan P B and Bürli R W (1999) Current Opinion in Chemical Biology 3: 688-693; Gottesfeld J M et al. (2000) Gene Expr. 9(1-2): 77-91]. These oligomers consist of the units 3-(dimethyl amino)propylamine, N-methyl-3-hydroxypyrrole, N-methylimidazole and N-methylpyrroles; they can be adapted to each portion of double-stranded DNA in such a way that they bind sequence-specifically to the large groove and block the expression of the gene sequences located in this position. Suitable methods have been described in Bremer R E et al. [(2001) Bioorg. Med. Chem. 9(8): 2093-103], Ansari A Z et al. [(2001) Chem. Biol. 8(6): 583-92], Gottesfeld J M et al. [(2001) J. Mol. Biol. 309(3): 615-29], Wurtz N R et al. [(2001) Org. Left 3(8): 1201-3], Wang C C et al. [(2001) Bioorg. Med. Chem. 9(3): 653-7], Urbach A R and Dervan P B [(2001) Proc. Natl. Acad. Sci. USA 98(8): 434103-8] and Chiang S Y et al. [(2000) J. Biol. Chem. 275(32): 24246-54].

G) Introduction of Viral Nucleic Acid Sequences and Expression Constructs which Bring about the Degradation of RNA Inactivation or downregulation can also be efficiently brought about by inducing specific RNA degradation by the organism, advantageously in the plant, with the aid of a viral expression system (Amplikon) [Angell, S M et al. (1999) Plant J. 20(3): 357-362]. Nucleic acid sequences with homology to the transcripts to be suppressed are introduced into the plant by these systems—also referred to as "VIGS" (viral induced gene silencing) with the aid of viral vectors. Then, transcription is switched off, presumably mediated by plant defense mechanisms against viruses. Suitable techniques and methods are described in Ratcliff F et al. [(2001) Plant J. 25(2): 237-45], Fagard M and Vaucheret H [(2000) Plant Mol. Biol. 43(2-3): 285-93], Anandalakshmi R et al. [(1998) Proc. Natl. Acad. Sci. USA 95(22): 13079-84] and Ruiz M T [(1998) Plant Cell 10(6): 937-46].

H) Introduction of Constructs for Inducing a Homologous Recombination on Endogenous Genes, for Example for Generating Knock-Out Mutants To generate a homologously-recombinant organism with reduced activity, a nucleic acid construct is used which, for example, comprises at least part of an endogenous gene which is modified by a deletion, addition or substitution of at least one nucleotide in such a way that the functionality is reduced or completely eliminated. The modification may also affect the regulatory elements (for example the promoter) of the gene so that the coding sequence remains unmodified, but expression (transcription and/or translation) does not take place or is reduced.

In the case of conventional homologous recombination, the modified region is flanked at its 5' and 3' end by further nucleic acid sequences, which must be sufficiently long for allowing recombination. Their length is, as a rule, in a range of from one hundred bases up to several kilobases [Thomas K R and Capecchi M R (1987) Cell 51: 503; Strepp et al. (1998) Proc. Natl. Acad. Sci. USA 95(8): 4368-4373]. In the case of homologous recombination, the host organism—for example a plant—is transformed with the recombination construct using the methods described herein below, and clones, which have successfully undergone recombination are selected using for example a resistance to antibiotics or herbicides. Using the cotransformation technique, the resistance to antibiotics or herbicides can subsequently advantageously be re-eliminated by performing crosses. An example for an efficient homologous recombination system in plants has been published in Nat. Biotechnol. 2002 October; 20(10):1030-4, Terada R et al.: Efficient gene targeting by homologous recombination in rice.

Homologous recombination is a relatively rare event in higher eukaryotes, especially in plants. Random integrations into the host genome predominate. One possibility of removing the randomly integrated sequences and thus increasing the number of cell clones with a correct homologous recombination is the use of a sequence-specific recombination system as described in U.S. Pat. No. 6,110,736, by means of which unspecifically integrated sequences can be deleted again, which simplifies the selection of events which have integrated successfully via homologous recombination. A multiplicity of sequence-specific recombination systems may be used, examples which may be mentioned being Cre/lox system of bacteriophage P1, the FLP/FRT system from yeast, the Gin recombinase of phage Mu, the Pin recombinase from *E. coli* and the R/RS system of the pSR1 plasmid. The bacteriophage P1 Cre/lox system and the yeast FLP/FRT system are preferred. The FLP/FRT and the cre/lox recombinase system have already been applied to plant systems [Odell et al. (1990) Mol. Gen. Genet. 223: 369-378].

I) Introduction of Mutations into Endogenous Genes for Bringing about a Loss of Function (for Example Generation of Stop Codons, Reading-Frame Shifts and the Like)

Further suitable methods for reducing activity are the introduction of nonsense mutations into endogenous genes, for example by introducing RNA/DNA oligonucleotides into the plant [Zhu et al. (2000) Nat. Biotechnol. 18(5): 555-558], and the generation of knock-out mutants with the aid of, for example, T-DNA mutagenesis [Koncz et al. (1992) Plant Mol. Biol. 20(5): 963-976], ENU-(N-ethyl-N-nitrosourea)-mutagenesis or homologous recombination [Hohn B and Puchta (1999) H. Proc. Natl. Acad. Sci. USA 96: 8321-8323]. Point mutations may also be generated by means of DNA-RNA hybrids also known as "chimeraplasty" [Cole-Strauss et al. (1999) Nucl. Acids Res. 27(5): 1323-1330; Kmiec (1999) Gene Therapy American Scientist 87(3): 240-247]. The mutation sites may be specifically targeted or randomly selected. If the mutations have been created randomly e.g. by Transposon-Tagging or chemical mutagenesis, the skilled worked is able to specifically enrich selected muation events in the inventive nucleic acids.

Nucleic acid sequences as described in item B) to I) are expressed in the cell or organism by transformation/transfection of the cell or organism or are introduced in the cell or organism by known methods, for example as disclosed in item A).

In one further embodiment of the process according to the invention, organisms are used in which one of the abovementioned genes, or one of the abovementioned nucleic acids, is mutated in such a manner that the activity of the encoded gene products is influenced by cellular factors to a greater extent than in the reference organism, as compared with the unmutated proteins. This kind of mutation could lead to an endogenous down-regulation of activity of the polypeptides of the invention which than causes an yield increase. In a further embodiment the process according to the invention, organisms are grown under such conditions, that the expression of the nucleic acids of the invention is reduced or repressed leading to an yield increase according to the invention.

Accordingly, in one embodiment, the process according to the invention relates to a process which comprises a) providing a plant cell, a plant tissue or a plant;

b) reducing, decreasing or deleting the activity in the plant cell, the plant tissue or the plant, of a protein having the biological activity of the protein of the invention or being encoded by the nucleic acid molecule of the present invention and described below, e.g. having above mentioned activity, e.g. conferring an increase in yield;

c) growing the plant cell, the plant tissue or the plant under conditions which permit the increase in yield of the plant cell, the plant tissue or the plant; and d) if desired, recovering the plant cell, the plant tissue, the fruit, the seed, the root, the tubers, the leaves, the blossoms or the whole plant.

After the above-described reducing, decreasing or deleting (which as defined above also encompasses the generating of an activity in an organism, i.e. a de novo activity), for example after the introduction and the expression of the an RNAi molecule, antisense molecule or ribozyme described in the methods or processes according to the invention, the organism according to the invention, advantageously, a plant, plant tissue or plant cell, is grown and subsequently harvested.

In the event that the transgenic host organism is a plant, plant tissue or plant cell such as plants selected from the group consisting of the families Anacardiaceae, Asteraceae, Apiaceae, Betulaceae, Boraginaceae, Brassicaceae, Bromeliaceae, Caricaceae, Cannabaceae, Convolvulaceae, Chenopodiaceae, Cucurbitaceae, Elaeagnaceae, Ericaceae, Euphorbiaceae, Fabaceae, Geraniaceae, Gramineae, Juglandaceae, Lauraceae, Leguminosae, Linaceae or perennial grass, fodder crops, vegetables, ornamentals and *Arabidopsis thaliana*. Such plants are either grown on a solid medium or as cells in a liquid medium, which is known to the skilled worker and suits the organism. Furthermore such plants can be grown in soil or the like. After the growing phase, the plants can be harvested. The plants or plant cells or the recovered, and if desired isolated plant parts as fruits, seeds, roots, tubers, leaves, blossoms can then be processed further directly into foodstuffs or animal feeds or for other applications.

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Cartha-* mus, Centaurea, Cichorium, Cynara, Helianthus, Lactuca, Locusta, Tagetes, Valeriana e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L var. *integrata, Lactuca scariola* L var. *integrifolia, Lactuca sativa* subsp. *romana, Locusta communes, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus columa* [hazelnut]; Boraginaceae such as the genera *Borago* e.g. the species *Borago officinalis* [borage]; Brassicaceae such as the genera *Brassica, Melanosinapis, Sinapis, Arabidopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta,* i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta* [manihot, arrowroot, tapioca, cassaya] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocois* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* [walnut, black walnut, common walnut, persian walnut, white walnut, butternut, black walnut]; Lauraceae such as the genera *Persea, Laurus* e.g. the species laurel *Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Unum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elacis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata.* [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cemuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum* [Sorghum, millet], *Oryza sativa, Oryza latifolia* [rice], *Zea mays* [corn, maize] *Triticum aestivum, Triticum durum, Triticum turgidum, Triticum hybemum, Triticum macha, Triticum sativum* or *Triticum vulgare* [wheat, bread wheat, common wheat], Proteaceae such as the genera *Macadamia* e.g. the species *Macadamia intergrifolia* [macadamia]; Rubiaceae such as the genera *Coffea* e.g. the species *Cofea* spp., *Coffea arabica, Coffea canephora* or *Coffea liberica* [coffee]; Scrophulariaceae such as the genera *Verbascum* e.g. the species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] (*Lycopersicon esculentum, Lycopersicon lycopersicum, Lycopersicon pyrifomme, Solanum integrifolium* or *Solanum lycopersicum* [tomato]; Sterculiaceae such as the genera *Theobroma* e.g. the species *Theobroma cacao* [cacao]; Theaceae such as the genera *Camellia* e.g. the species *Camellia sinensis*) [tea]. All abovementioned host organisms are also useable as source organisms for the nucleic acid sequences of the invention.

Particular preferred plants are plants selected from the group consisting of maize, soja, canola, wheat, barley, triticale, rice, linseed, sunflower, potato and *Arabidopsis*.

With regard to the nucleic acid sequences as depicted in SEQ ID NO: 1 or SEQ ID NO: 113 a nucleic acid construct which contains one of said nucleic acid sequences or an organism (=transgenic organism) which is transformed with one of said nucleic acid sequences or one of said nucleic acid constructs, "transgene" means all those constructs which have been brought about by genetic manipulation methods and in which either
a) the nucleic acid sequences as depicted in SEQ ID NO: 1, SEQ ID NO: 113 or a derivative thereof, or
b) a genetic regulatory element, for example a promoter, which is functionally linked to one of said nucleic acid sequences as depicted in SEQ ID NO: 1, SEQ ID NO: 113 or a derivative thereof,
or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide radicals. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the expression of the nucleic acids used in the process according to the invention in a non-natural position in the genome, that is to say the expression of the nucleic acids is homologous or, preferably, heterologous. This expression can be transiently or of a sequence integrated stably into the genome.

The use of the nucleic acid sequence according to the invention or of the nucleic acid construct according to the invention for the generation of transgenic plants is therefore also subject matter of the invention.

Another embodiment of the invention is a process for the modification of the nucleic acid molecules of the invention encoded by the host organism for example by random mutagenesis with chemicals, radiation or UV-light or side directed mutagenesis in such a manner that the yield of the plant is increased. This embodiment of the invention shall be deemed as transgenic in the sense of the invention.

In this context, the yield of the plant or plant part of the invention may be increased according to the process of the invention by at least a factor of 1.1, preferably at least a factor of 1.2; 1.3; 1.4; or 1.5, especially preferably by at least a factor of 1.6 or 17.5, very especially preferably by at least a factor of 2, in comparison with the wild type, control or reference. Preferably, said increase is found in a tissue, more preferred in a plant or in a harvestable part thereof.

In the inventive process as mentioned above preferably the reduction, decrease or deletion of the biological activity represented by protein of the invention is achieved by reducing, decreasing or deleting the expression of at least one nucleic acid molecule, wherein the nucleic acid molecule is selected from the group consisting of:
a) nucleic acid molecule encoding, preferably at least the mature form, of the polypeptide shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ. ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;
b) nucleic acid molecule comprising, preferably at least the mature form, of the nucleic acid molecule shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287;
c) nucleic acid molecule comprising a nucleic acid sequence, which, as a result of the degeneracy of the genetic code, can be derived from a polypeptide sequence depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 and having the biological activity represented by protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;
d) nucleic acid molecule encoding a polypeptide having at least 50% identity with the amino acid sequence of the polypeptide encoded by the nucleic acid molecule of (a) to (c) and having the biological activity represented by protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56; SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

e) nucleic acid molecule which comprises a polynucleotide which is obtained by amplifying a cDNA library or a genomic library using the primers depicted in SEQ ID NO: 92 and SEQ ID NO: 93 and having the biological activity represented by protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112 or using the primers depicted in SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263 or SEQ ID NO: 264 and having the biological activity of SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

f) nucleic acid molecule which encodes a polypeptide, the polypeptide being derived by substituting, deleting and/or adding one or more amino acids of the amino acid sequence of the polypeptide encoded by the nucleic acid molecules (a) to (d), preferably to (a) to (b) or (c) and encoding a polypeptide having the biological activity represented by protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

g) nucleic acid molecule which encodes a fragment or an epitope of a polypeptide which is encoded by one of the nucleic acid molecules of (a) to (e), preferably to (a) to (b)

or (c) and encoding a polypeptide having the biological activity represented by protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO:112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

h) nucleic acid molecule encoding a polypeptide which is isolated with the aid of monoclonal or polyclonal antibodies against a polypeptide encoded by one of the nucleic acid molecules of (a) to (e), preferably to (a) to (b) or (c), and having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

i) nucleic acid molecule encoding a polypeptide comprising the consensus sequence shown in shown in SEQ ID NO: 87 or SEQ ID NO: 88 or SEQ ID NO: 89 or SEQ ID NO: 90 or SEQ ID NO: 91 or SEQ ID NO: 265 or SEQ ID NO: 266 or SEQ ID NO: 267 or SEQ ID NO: 268 and having the biological activity represented by the protein as depicted in SEQ ID NO: 2 or SEQ ID NO: 113;

j) nucleic acid molecule encoding a polypeptide having the biological activity represented by the protein SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

and k) nucleic acid molecule which is obtainable by screening a suitable nucleic acid library under stringent hybridisation conditions with a probe comprising one of the sequences of the nucleic acid molecule of (a) or (b) or with a fragment thereof having at least 15 nt, preferably 20 nt, 30 nt, 50 nt, 100 nt, 200 nt or 500 nt of the nucleic acid molecule characterized in (a) to (c) and encoding a polypeptide having the biological activity represented by protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288;

or which comprises a sequence which is complementary thereto.

In one embodiment, the nucleic acid molecule used in the process distinguishes over the sequence depicted in SEQ ID NO: 1 or SEQ ID NO: 113 by at least one or more nucleotides or does not consist of the sequence shown in SEQ ID NO: 1 or SEQ ID NO: 113. In one embodiment, the nucleic acid molecule of the present invention is less than 100%, 99.999%, 99.99%, 99.9% or 99% identical to the sequence shown in SEQ ID NO: 1 or SEQ ID NO: 113. In another embodiment, the nucleic acid molecule does not consist of the sequence shown in SEQ ID NO: 1 or SEQ ID NO: 113.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term sequence may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

Nucleic acid molecules with the sequence shown in SEQ ID NO: 1 or SEQ ID NO: 113, nucleic acid molecules which are derived from the amino acid sequences shown in SEQ ID NO: 2 or SEQ ID NO: 114 or their derivatives or homologues encoding polypeptides with the enzymatic or biological activity of protein of the invention or conferring the yield increase after reducing, decreasing or deleting its expression or activity in the process according to the invention. These sequences are cloned in such a manner into nucleic acid constructs that their activity is reduced, decreased or deleted, either individually or in combination with other sequences involved in yield. These nucleic acid constructs enable an optimal growth and yield in the process according to the invention.

Nucleic acid molecules, which are advantageous for the process according to the invention and which encode polypeptides with the biological activity represented by the protein of the invention and/or conferring the yield increase can be determined from generally accessible databases. Those, which must be mentioned, in particular in this context are general gene databases such as the EMBL database (Stoesser G. et al., Nucleic Acids Res 2001, Vol. 29, 17-21), the GenBank database (Benson D. A. et al., Nucleic acid molecules, which are advantageous for the process according to the invention and which encode polypeptides with the biological activity represented by the protein of the invention and/or conferring the yield increase can be determined from generally accessible databases. Those, which must be mentioned, in particular in this context are general gene databases such as the EMBL database (Stoesser G. et al., Nucleic Acids Res 2001, Vol. 29, 17-21), the GenBank database (Benson D. A. et al., Nucleic Acids Res 2000, Vol. 28, 15-18), or the PIR database (Barker W. C. et al., Nucleic Acids Res. 1999, Vol. 27, 39-43). It is furthermore possible to use organism-specific gene databases for determining advantageous sequences, in the case of yeast for example advantageously the SGD database (Cherry J. M. et al., Nucleic Acids Res. 1998, Vol. 26, 73-80) or the MIPS database (Mewes H. W. et al., Nucleic Acids Res. 1999, Vol. 27, 44-48), in the case of E. coli the GenProtEC database (web.bham.ac.uk/bcm4ght6/res.html), and in the case of Arabidopsis the TAIR-database (Huala, E. et al., Nucleic Acids Res. 2001 Vol. 29(1), 102-5) or the MIPS database.

The nucleic acid molecules used in the process according to the invention take the form of isolated nucleic acid sequences, which encode polypeptides with the biological activity of the protein of the invention enabling the yield increase by reducing, decreasing or deleting their activity. The nucleic acid sequence(s) used in the process for yield increase in transgenic organisms originate advantageously from an eukaryote but may also originate from a prokaryote or an archebacterium, thus it can be derived from e.g. a microorganism, an animal or a plant.

For the purposes of the invention, as a rule the plural is intended to encompass the singular and vice versa.

In order to improve the introduction of the nucleic acid sequences and the reduction, decrease or deletion of the expression of the sequences in the transgenic organisms, which are used in the process, the nucleic acid sequences are incorporated into a nucleic acid construct and/or a vector in such a manner that they are reduced, decreased or deleted in respect to the biological activity either on the nucleic acid sequence expression level or on the level of the polypeptide or protein encoded by said sequences. In addition to the herein described sequences which are used in the process according to the invention, further nucleic acid sequences, advantageously of genes coding for oligopeptide transporter proteins according to the invention, may additionally be pre-sent in the nucleic acid construct or in the vector and may be introduced into the plant in order to reduce the expression of the polynucleotides of the invention. However, these additional sequences may also be introduced into the plant via other, separate nucleic acid constructs or vectors.

Using the herein mentioned cloning vectors and transformation methods such as those which are published and cited in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus, Annu. Rev. Plant Physiol. Plant Molec. Biol. 42 (1991), 205-225)) and further cited below, the nucleic acids may be used for the recombinant modification of a wide range of organisms, in particular prokaryotic or eukaryotic microorganisms or plants, so their yield is increased.

In one embodiment, the nucleic acid molecule according to the invention originates from a plant, such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Uliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus columa, Borago officinalis; Brassica napus, Brassica rapa* ssp., *Sinapis arvensis, Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max, Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Unum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybemum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum, Lycopersicon pyriforme, Solanum integrifolium, Solanum lycopersicum, Theobroma cacao* or *Camellia sinensis*.

However, it is also possible to use artificial sequences, which differ preferably in one or more bases from the nucleic acid sequences as characterized in the invention or in one or more amino acid molecules from polypeptide sequences as characterized in the invention, and which mediate a polypeptide having above-mentioned activity, e.g. having the biological activity of the protein of the invention or conferring the yield increase after reducing, decreasing or deleting its expression or activity.

In the process according to the invention nucleic acid sequences can be used, which if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes. In the event for example the RNAi or antisense technology is used also the 5'- and/or 3'-regions can advantageously be used.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example a nucleic acid molecule with a nucleotide sequence of SEQ ID NO: 1 or SEQ ID NO: 113 or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process. A nucleic acid molecule encompassing a complete sequence of SEQ ID NO: 1 or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this very sequence. For example, mRNA can be isolated from cells [for example by means of the guanidinium thiocyanate extraction method of Chirgwin et al. (1979) Biochemistry 18:5294-5299] and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.). Synthetic oligonucleotide primers for the amplification by means of polymerase chain reaction can be generated on the basis of a sequence shown herein, for example the sequence shown in SEQ ID NO: 1 or the sequences derived from SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63; SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111 or the sequences derived from SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287.

Such primers can be used to amplify nucleic acids sequences for example from cDNA libraries or from genomic libraries and identify nucleic acid molecules, which are useful in the inventive process and which have the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288.

Advantageously the primers as depicted in SEQ ID NO: 92 and 93 are used—see table 1.

TABLE 1

Preferred primers

| Primer name | SEQ ID NO: | Sequence | Length_F/R |
|---|---|---|---|
| at5g64410start | 92 | ATggCCACCgCCgACgAATTCT | forward |
| at5g64410stop | 93 | TTATTTAACCggACAACCATCAACA | reverse |

Moreover, it is possible to identify conserved regions from various organisms by carrying out protein sequence alignments with the polypeptide of the invention, in particular with the sequences shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110 or SEQ ID NO: 112 from which conserved regions, and in turn, degenerate primers can be derived. Such a conserved region for the polypeptide of the invention, is shown in SEQ ID NO: 87, SEQ ID NO: 88, SEQ ID NO: 89, SEQ ID NO: 90 and SEQ ID NO: 91. Degenerate primers can then be utilized by PCR for the amplification of fragments of novel coding regions coding for proteins having above-mentioned activity, e.g. conferring the increase of the yield after reducing, decreasing or deleting the expression or activity of the respective nucleic acid sequence or the protein encoded by said sequence, which having the biological activity of the protein of the invention or further functional homologs of the polypeptide of the invention from other organisms.

Moreover, it is possible to identify conserved regions from various organisms by carrying out protein sequence alignments with the polypeptide of the invention, in particular with the sequences shown in SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 from which conserved regions, and in turn, degenerate primers can be derived. Such a conserved region for the polypeptide of the invention is shown in SEQ ID NO: 265, SEQ ID NO: 266, SEQ ID NO: 267 and SEQ ID NO: 268. Degenerate primers can then be utilized by PCR for the amplification of fragments of novel coding regions coding for proteins having above-mentioned activity, e.g. conferring the increase in yield after reducing, decreasing or deleting the expression or activity of the respective nucleic acid sequence or the protein encoded by said sequence, which having the biological activity of the protein of the invention or further functional homologs of the polypeptide of the invention from other organisms.

These fragments can then be utilized as hybridization probe for isolating the complete gene sequence. As an alternative, the missing 5' and 3' sequences can be isolated by means of RACE-PCR. A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process, can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of SEQ ID NO: 1 or SEQ ID NO: 113. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can for example be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, $2^{nd}$ Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, nonlimiting example of stringent Southern blot hybridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solventsare present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA: RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can combined case by case so that not all possibilities can be mentioned herein.

Some examples of conditions for DNA hybridization (Southern blot assays) and wash step are shown below:
(1) Hybridization conditions can be selected, for example, from the following conditions:
  a) 4×SSC at 65° C.,
  b) 6×SSC at 45° C.,
  c) 6×SSC, 100 mg/ml denatured fragmented fish sperm DNA at 68° C.,
  d) 6×SSC, 0.5% SDS, 100 mg/ml denatured salmon sperm DNA at 68° C.,
  e) 6×SSC, 0.5% SDS, 100 mg/ml denatured fragmented salmon sperm DNA, 50% formamide at 42° C.,
  f) 50% formamide, 4×SSC at 42° C.,
  g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
  h) 2× or 4×SSC at 50° C. (low-stringency condition), or
  i) 30 to 40% formamide, 2× or 4×SSC at 42° C. (low-stringency condition).
(2) Wash steps can be selected, for example, from the following conditions:
  a) 0.015 M NaCl/0.0015 M sodium citrate/0.1% SDS at 50° C.
  b) 0.1×SSC at 65° C.
  c) 0.1×SSC, 0.5% SDS at 68° C.
  d) 0.1×SSC, 0.5% SDS, 50% formamide at 42° C.
  e) 0.2×SSC, 0.1% SDS at 42° C.
  f) 2×SSC at 65° C. (low-stringency condition).
  g) 0.2×SSC, 0.1% SDS at 60° C. (medium-high stringency conditions), or
  h) 0.1×SSC, 0.1% SDS at 60° C. (medium-high stringency conditions), or
  i) 0.2×SSC, 0.1% SDS at 65° C. (high stringency conditions), or
  h) 0.1×SSC, 0.1% SDS at 65° C. (high stringency conditions)

Polypeptides having above-mentioned activity, e.g. conferring the yield increase, derived from other organisms, can be encoded by other DNA sequences, which hybridize to the sequences shown in SEQ ID NO: 1 or SEQ ID NO: 113 under relaxed hybridization conditions and which code on expression for peptides having the further biological activities of the protein of the invention.

Further, some applications have to be performed at low stringency hybridization conditions, without any consequences for the specificity of the hybridization. For example, a Southern blot analysis of total DNA could be probed with a nucleic acid molecule of the present invention and washed at low stringency (55° C. in 2×SSPE, 0.1% SDS). The hybridisation analysis could reveal a simple pattern of only genes encoding polypeptides of the present invention, e.g. having herein-mentioned yield increasing activity and/or having also the biological activity of an oligopeptide transporter protein as used in the invention. A further example of such low-stringent hybridization conditions is 4×SSC at 50° C. or hybridization with 30 to 40% formamide at 42° C. Such molecules comprise those which are fragments, analogues or derivatives of the polypeptide of the invention and differ, for example, by way of amino acid and/or nucleotide deletion(s), insertion(s), substitution(s), addition(s) and/or recombination(s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence or sequence fragment with at least 15, 20, 21, 22, 23, 24, 25, 26, 27, 28, 29, 30 bp in length with at least 90, 91, 92, 93, 94, 95, 96, 97, 98 or 99% identity preferably 100% identity with a fragment of the nucleic acid molecules of the invention for example with the sequences shown in SEQ ID NO: 1 or SEQ ID NO: 113. Said truncated sequences can as mentioned vary widely in length from 15 bp up to 2 kb or more, advantageously the sequences have a minimal length of 15, 20, 25, 30, 35 or 40 bp, while the maximum size is not critical. 100, 200, 300, 400, 500 or more base pair fragments can be used. In some applications, the maximum size usually is not substantially greater than that required to provide the complete gene function(s) of the nucleic acid sequences of the invention. Such sequences can advantageously been used for the repression, reduction, decrease or deletion of the biological activity of the nucleic acid molecules and/or proteins of the invention by for example the RNAi- or antisense-technology. For the reduction, decrease or deletion of the biological activity of the inventive nucleic acid sequence and/or the inventive protein also the promotor regions of the disclosed nucleic acid sequences can be used. The skilled worker knows how to clone said promotor regions.

Typically, the truncated amino acid sequence will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to an epitope of the polypeptide of the present invention.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 is one which is sufficiently complementary to one of the nucleotide sequences shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 such that it can hybridize to one of the nucleotide sequences shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO. 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and vice versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193; SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or a portion thereof and/or has the biological activity of the protein of the invention or the nucleic acid molecule encoding said protein. The nucleic acid molecule of the invention comprises a nucleotide sequence which hybridizes, preferably hybridizes under stringent conditions as defined herein, to one of the nucleotide sequences shown in SEQ ID NO: 1, SEQ ID NO: 3, SEQ ID NO: 5, SEQ ID NO: 7, SEQ ID NO: 9, SEQ ID NO: 11 SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or a portion thereof and encodes a protein having aforementioned activity, e.g. conferring a yield increase upon the reduction of deletion of its activity, and optionally, the biological activity of the protein of the invention.

Moreover, the nucleic acid molecule of the invention can comprise only a portion of the coding region of one of the sequences in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 for example a fragment which can be used as a probe or primer or a fragment encoding a biologically active portion of the nucleic acid molecule or polypeptide of the present invention or a fragment encoding a non active part of the nucleic acid molecule or the polypeptide of the invention, i.e. having abovementioned activity, e.g. conferring an increase in yield if its expression or activity is decreased. The nucleotide sequences determined from the cloning of the present protein according to the invention encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO:

269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 an anti-sense sequence of one of the sequences, e.g., set forth in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 or naturally occurring mutants thereof. Primers based on a nucleotide of invention can be used in PCR reactions to clone homologues of the polypeptide of the invention, e.g. as the primers described in the examples of the present invention, e.g. as shown in the examples. Said nucleic acid molecules, which are homologues of the sequence of the invention or the nucleic acid molecules of the invention themselves can be used to reduce, decrease or delete the biological activity of the nucleic acid molecules and/or proteins of the invention.

Primer sets are interchangeable. The person skilled in the art knows to combine said primers to result in the desired product, e.g. in a full-length clone or a partial sequence. Probes based on the sequences of the nucleic acid molecule of the invention can be used to detect transcripts or genomic sequences encoding the same or homologous proteins. The probe can further comprise a label group attached thereto, e.g. the label group can be a radioisotope, a fluorescent compound, an enzyme, or an enzyme cofactor. Such probes can be used as a part of a genomic marker test kit for identifying cells which express or does not express a polypeptide of the invention, such as by measuring a level of an encoding nucleic acid molecule in a sample of cells, e.g., detecting mRNA levels or determining, whether a genomic gene comprising the sequence of the polynucleotide of the invention has been mutated or deleted.

The nucleic acid molecule of the invention encodes a polypeptide or portion thereof which includes an amino acid sequence which is sufficiently homologous to the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 such that the protein or portion thereof maintains the ability to participate in the yield increase, in particular a compound such as the protein of the invention which is involved in the reduction, decrease and/or deletion of the yield increase by for example metabolization, degradation or export of undesired chemical compounds and thereby increasing the yield upon the reduction or deletion of its activity as mentioned above or as described in the examples in plants is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288. Portions of the aforementioned amino acid sequence are at least 3, 5, 10, 20, 30, 40, 50 or more amino acids in length. Nucleic acid sequences, which as a result of the degeneracy of the genetic code, can be derived from said polypeptide sequences can be used for the repression, decrease or deletion of the biological activity of the polypeptide or the nucleic acid molecule of the invention according to the disclosure herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70% and more preferably at least about 75%, 80%, 85%, 90%, 91%, 92%, 93% or 94% and most preferably at least about 95%, 97%, 98%, 99% or more homologous to an entire amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 and having above-mentioned activity, e.g. conferring preferably the increase in yield upon being reduced in its activity.

Portions of proteins encoded by the nucleic acid molecule of the invention are preferably in such a manner biologically active, that they are increasing the yield of plant growth by being in its biological activity reduced, decreased or deleted.

As mentioned herein, the term "biologically active portion" is intended to include a portion, e.g., a domain/motif, that confers by introducing said nucleic acid sequence or part thereof an increase of the yield in plant growth.

The invention further relates to nucleic acid molecules which are used in the inventive process and which as a result of degeneracy of the genetic code can be derived from a polypeptide sequence as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 and thus encoding a polypeptide of the present invention, in particular a polypeptide leading by reducing, decreasing or deleting its biological activity to an increase of the yield of plant growth. Advantageously, the nucleic acid molecule of the invention comprises, or in an other embodiment has, a nucleotide sequence encoding a protein comprising, or in an other embodiment having, an amino acid sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 which differ from said amino acid sequences in at least one or more amino acids.

In addition, it will be appreciated by those skilled in the art that DNA sequence polymorphisms that lead to changes in the amino acid sequences may exist within a population. Such genetic polymorphism in the gene encoding the polypeptide of the invention or comprising the nucleic acid molecule of the invention may exist among individuals within a population due to natural variation.

As used herein, the terms "gene" and "recombinant gene" refer to nucleic acid molecules comprising an open reading frame encoding the polypeptide of the invention or comprising the nucleic acid molecule of the invention, preferably encoding the polypeptide of the invention or comprising the nucleic acid molecule of the invention derived from a crop plant or from a microorganism useful for increasing the yield in plants upon reduction in its activity, in particular encoding a oligopeptide transporter protein of the invention or comprising the nucleic acid molecule of the invention derived from a crop plant or a microorganism for increasing the growth of plants or plant parts upon reduction of its activity. Such natural variations can typically result in 1-5% variance in the nucleotide sequence of the gene used in the inventive process. Any and all such nucleotide variations and resulting amino acid polymorphisms in genes encoding a polypeptide of the invention or comprising the nucleic acid molecule of the invention that are the result of natural variation and that in the event of reducing, decreasing or deleting its biological activity do not alter the functional activity as described are intended to be within the scope of the invention.

Nucleic acid molecules corresponding to natural variants homologues of a nucleic acid molecule of the invention, which can also be a cDNA, can be isolated based on their homology to the nucleic acid molecules disclosed herein using the nucleic acid molecule of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention, e.g. comprising the sequence shown in SEQ ID NO: 1 or SEQ ID NO: 113. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences of at least 30%, 40%, 50% or 65% identical to each other typically remain hybridized to each other. Preferably, the conditions are such that sequences of at least about 70%, more preferably at least about 75% or 80%, and even more preferably of at least about 85%, 90% or 95% or more identical to each other typically remain hybridized to each other.

Preferably, nucleic acid molecule of the invention that hybridizes under stringent conditions to a sequence of SEQ ID NO: 1 or SEQ ID NO: 113 corresponds to a naturally-occurring nucleic acid molecule of the invention. As used herein, a "naturally-occurring" nucleic acid molecule refers to a RNA or DNA molecule having a nucleotide sequence that occurs in nature (e.g., encodes a natural protein). Preferably, the nucleic acid molecule encodes a natural protein having above-mentioned activity, e.g. conferring increase in plant growth or plant parts after reducing, decreasing or deleting the expression or activity thereof or the activity of a protein having the biological activity of the protein of the invention.

In addition to naturally-occurring variants of the nucleic acid or protein sequence of the invention that may exist in the population, the skilled artisan will further appreciate that changes can be introduced by mutation into a nucleotide sequence of the nucleic acid molecule encoding the polypeptide of the invention, thereby leading to changes in the amino acid sequence of the encoded polypeptide of the invention and thereby altering the functional ability of the polypeptide, meaning preferably reducing, decreasing or deleting said activity. For example, nucleotide substitutions leading to amino acid substitutions at "essential" amino acid residues can be made in a sequence of the nucleic acid molecule of the invention, e.g. in SEQ ID NO: 1 or SEQ ID NO: 113. An "essential" amino acid residue is a residue that if altered from the wild-type sequence of one of the polypeptide of the invention lead to an altered activity of said polypeptide, whereas a "non-essential" amino acid residue is not required for the activity of the protein for example for the activity as an enzyme. The alteration of "essential" residues lead to a reduced decreased or deleted activity of the polypeptides of the invention. Preferably activity is reduced, decreased or deleted that means preferably essential amino acid residues and/or more non-essential residues are changed and thereby the activity is reduced, which leads as mentioned above to an increase in growth of plants or plant parts after decreasing the expression or activity of the polypeptide of the invention. Other amino acid residues, however, (e.g., those that are not conserved or only semi-conserved in the domain having said activity) may not be essential for activity and thus are likely to be amenable to alteration without altering said activity are less preferred.

Further, a person skilled in the art knows that the codon usage between organisms can differ. Therefore, he will adapt the codon usage in the nucleic acid molecule of the present invention to the usage of the organism in which the polynucleotide or polypeptide is expressed, so that the expression of the nucleic acid molecule or the encoded protein of the invention is more likely reduced.

Accordingly, the invention relates to nucleic acid molecules encoding polypeptide having abovementioned activity, e.g. conferring an increased growth in a plant or plant part. Such polypeptides differ in amino acid sequence from a sequence contained in, SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 102, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 yet do not retain said biological activity described herein and thereby enabling the increase in growth. The nucleic acid molecule can comprise a nucleotide sequence encoding a polypeptide, wherein the polypeptide comprises an amino acid sequence at least about 50% identical to an amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 and is capable of participation in the increase of plant growth after decreasing its expression or its biological function. Preferably, the protein encoded by the nucleic acid molecule is at least about 60%, 70% or 80% identical to the sequence in SEQ ID NO: 2 or SEQ ID NO: 114, more preferably at least about 85% identical to SEQ ID NO: 2 or SEQ ID NO: 114, even more preferably at least about 90%, 91%, 92%, 93%, 94%, 95% homologous to the sequence in SEQ ID NO: 2 or SEQ ID NO: 114, and most preferably at least about 96%, 97%, 98%, or 99% identical to the sequence in SEQ ID NO: 2 or SEQ ID NO: 114.

To determine the percentage homology (=identity) of two amino acid sequences (for example of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288) or of two nucleic acid molecules (for example of the sequence SEQ ID NO: 1 or SEQ ID NO: 3, the sequences are written one underneath the other for an optimal comparison (for example gaps may be inserted into the sequence of a protein or of a nucleic acid in order to generate an optimal alignment with the other protein or the other nucleic acid). The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms for this description.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTAMethods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the querry. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=−3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perform gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -l Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution, 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of nucleic acid sequences were used: gap weight 50, length weight: 3, average match: 10.000, average mismatch: 0.000.

For example a sequence which has a 80% homology with sequence SEQ ID NO: 1 at the nucleic acid level is understood as meaning a sequence which, upon comparison with the sequence SEQ ID NO: 1 by the above Gap program algorithm with the above parameter set, has 80% homology.

Homology between two polypeptides is understood as meaning the identity of the amino acid sequence over in each case the entire sequence length which is calculated by comparison with the aid of the program algorithm Gap (Wisconsin Package Version 10.0, University of Wisconsin, Genetics Computer Group (GCG), Madison, USA), setting the following parameters: gap weight: 8; length weight 2; average match: 2.912; average mismatch: −2.003.

For example a sequence which has a 80% homology with sequence SEQ ID NO: 2 at the protein level is understood as meaning a sequence which, upon comparison with the sequence SEQ ID NO: 2 by the above Gap program algorithm with the above parameter set, has 80% homology.

Functional equivalents derived from one of the polypeptides as shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 according to the invention and are characterized by essentially the same properties as the polypeptide as shown in SEQ ID NO: 2 or SEQ ID NO: 114 of *A. thaliana*.

Functional equivalents derived from the nucleic acid sequences as shown in SEQ ID NO: 1 or SEQ ID NO: 113 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112 or SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 respectively according to the invention and encode polypeptides having essentially the same properties as the polypeptide as shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112 or SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288.

"Essentially the same properties" of a functional equivalent is above all understood as meaning that the functional equivalent has above mentioned activity, e.g. conferring an increasing growth of plants or plant parts while decreasing the amount of protein, activity or function of said functional equivalent in a plant, in a plant tissue, plant cells or a part of the same.

A nucleic acid molecule encoding a homologe to a protein sequence SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112 or SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 can be created by introducing one or more nucleotide substitutions, additions or deletions into a nucleotide sequence of the nucleic acid molecule of the present invention, in particular of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111 or SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 such that one or more amino acid substitutions, additions or deletions are introduced into the encoded protein. Mutations can be introduced into the sequences of, e.g. SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO:169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO:207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 by standard techniques, such as site-directed mutagenesis and PCR-mediated mutagenesis.

Preferably, non-conservative amino acid substitutions are made at one or more predicted nonessential or preferably essential amino acid residues and thereby reducing, decreasing or deleting the activity of the respective protein. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Thus, a predicted nonessential or essential amino acid residue in a polypeptide of the invention is preferably replaced with another amino acid residue from another family. Alternatively, in another embodiment, mutations can be introduced randomly along all or part of a coding sequence of a nucleic acid molecule of the invention, such as by saturation mutagenesis, and the resultant mutants can be screened for activity described herein to identify mutants that lost or have decreased biological activity, e.g. conferring an increase in plant growth or growth of plant parts.

Most preferably the activity of the polypeptides of the invention can be reduced or deleted by for example creation of stop codons through mutation or insertions.

Following mutagenesis of one of the sequences of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 the encoded protein can be expressed recombinantly and the activity of the protein can be determined using, for example, assays described herein (see Examples).

The highest homology of the polypeptide molecule SEQ ID NO: 2 used in the process according to the invention was found for the following database entries by Gap search:

| Hit | Best Homolog | % Identity |
| --- | --- | --- |
| SEQ ID NO: 2 | SPTREMBL_Q6YUP9 | 88 |
| SEQ ID NO: 2 | SPTREMBL_Q8S2I4 | 87 |
| SEQ ID NO: 2 | SPTREMBL_Q7F9L4 | 86 |
| SEQ ID NO: 2 | PIR_F86233 | 84 |
| SEQ ID NO: 2 | PIR_T01900 | 80 |
| SEQ ID NO: 2 | SPTREMBL_Q8H641 | 80 |

Homologs of the nucleic acid sequences used, with the sequence SEQ ID NO: 1 or of the nucleic acid sequences derived from the sequences SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111 comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from SEQ ID NO: 1, or from the derived nucleic acid sequences, the intention being, however, that the enzyme activity or the biological activity of the resulting proteins synthesized is advantageously lost or decreased.

Homologs of the nucleic acid sequences used, with the sequence SEQ ID NO: 113 or of the nucleic acid sequences derived from the sequences SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from SEQ ID NO: 113, or from the derived nucleic acid sequences, the intention being, however, that the enzyme activity or the biological activity of the resulting proteins synthesized is advantageously lost or decreased.

In one embodiment of the present invention, the nucleic acid molecule comprises the sequence shown in SEQ ID NO: 1 or SEQ ID NO: 113. It is preferred that the nucleic acid molecule comprises as little as possible other nucleotides not shown in SEQ ID NO: 1 or SEQ ID NO: 113. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides.

Also preferred is that the nucleic acid molecule of the invention encodes a polypeptide comprising the sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288.

In one embodiment, the nucleic acid molecule encodes less than 150, 130, 100, 80, 60, 50, 40 or 30 further amino acids.

In a further embodiment, the encoded polypeptide comprises less than 20, 15, 10, 9, 8, 7, 6 or 5 further amino acids. In one embodiment used in the inventive process, the encoded polypeptide is identical to the sequences shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ D NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288.

In one embodiment, the nucleic acid molecule encoding a polypeptide comprising the sequence shown in SEQ ID NO: 1 or SEQ ID NO: 113 comprises less than 100 further nucleotides. In a further embodiment, the nucleic acid molecule comprises less than 30 further nucleotides.

Polypeptides (=proteins), which still have the abovementioned activity of the polypeptide of the present invention, e.g. conferring an increase of growth in plants or plant parts or having the biological activity of an oligopeptide transporter protein of the invention, i.e. polypeptides whose activity is essentially reduced, are polypeptides by at least 10% or 20%, by preference 30% or 40%, especially preferably 50% or 60%, very especially preferably 80% or 90% or more in comparison to the wild type biological activity or enzyme activity, advantageously, the activity is essentially reduced in comparison with the activity of a protein encoded by SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 and expressed under identical conditions.

Homologs of SEQ ID NO: 1 or of the derived sequences of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111 also mean truncated sequences, cDNA, single-stranded DNA or RNA of the coding and noncoding DNA sequence. Homologus of SEQ ID NO: 1 or the derived sequences of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111 are also understood as meaning derivatives which comprise noncoding regions such as, for example, UTRs, terminators, enhancers or promoter variants. The promoters upstream of the nucleotide sequences stated can be modified by one or more nucleotide substitution(s), insertion(s) and/or deletion(s) with, however, preferably interfering with the functionality or activity either of the promoters, the open reading frame (=ORF) or with the 3'-regulatory region such as terminators or other 3' regulatory regions, which are far away from the ORF. It is furthermore possible that the activity of the promoters is decreased by modification of their sequence or their regulation, or that they are replaced completely by less active promoters and thereby the activity of the expressed nucleic acid sequence is reduced or deleted, even promoters from heterologous organisms. Appropriate promoters are known to the person skilled in the art and are mentioned herein below. Further methods exists to modulate the promoters of the genes of the invention, e.g. by modifying the activity of transacting factors, meaning natural or artificial transcription factors, which can bind to the promoter and influence its activity. Furthermore it is possible to influence promoters of interest by modifying upstream signaling components like receptors or kinases, which are involved in the regulation of the promoter of interest.

Homologs of SEQ ID NO: 113 or of the derived sequences of SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 also mean truncated sequences, cDNA, single-stranded DNA or RNA of the coding and noncoding DNA sequence. Homologus of SEQ ID NO: 113 or the derived sequences of are also understood as meaning derivatives which comprise noncoding regions such as, for example, UTRs, terminators, enhancers or promoter variants. The promoters upstream of the nucleotide sequences stated can be modified by one or more nucleotide substitution(s), insertion(s) and/or deletion(s) with, however, preferably interfering with the functionality or activity either of the promoters, the open reading frame (=ORF) or with the 3'-regulatory region such as terminators or other 3' regulatory regions, which are far away from the ORF. It is furthermore possible that the activity of the promoters is decreased by modification of their sequence or their regulation, or that they are replaced completely by less active promoters and thereby the activity of the expressed nucleic acid sequence is reduced or deleted, even promoters from heterologous organisms. Appropriate promoters are known to the person skilled in the art and are mentioned herein below. Further methods exists to modulate the promoters of the genes of the invention, e.g. by modifying the activity of transacting factors, meaning natural or artificial transcription factors, which can bind to the promoter and influence its activity. Furthermore it is possible to influence promoters of interest by modifying upstream signaling components like receptors or kinases, which are involved in the regulation of the promoter of interest.

In a further embodiment, the process according to the present invention comprises the following steps:
(a) selecting an organism or a part thereof expressing the polypeptide of this invention;
(b) mutagenizing the selected organism or the part thereof;
(c) comparing the activity or the expression level of said polypeptide in the mutagenized organism or the part thereof with the activity or the expression of said polypeptide in the selected organisms or the part thereof;
(d) selecting the mutagenized organisms or parts thereof, which comprise a decreased activity or expression level of said polypeptide compared to the selected organism (a) or the part thereof;
(e) optionally, growing and cultivating the organisms or the parts thereof; and
(f) harvesting the organisms or parts therefore like e.g. seeds, fruits.

The organisms or part thereof show according to the herein mentioned process of the invention an increased growth of the plant compared to said control or selected plant or parts thereof.

Advantageously the selected plants were mutagenized according to the invention. According to the invention mutagenesis is any change of the genetic information in the genome of a plant, that means any structural or compositional change in the nucleic acid preferably DNA of a plant that is not caused by normal segregation or genetic recombination processes. Such mutations may occur spontaneously, or may be induced by mutagens as described below. Such change can be induced either randomly or selectively. In both cases the genetic information of the plant is modified. In general this leads to the situation that the activity of the gene product of the relevant genes inside the cells or inside the plant is reduced or repressed.

In case of the specific or site directed mutagenesis a distinct gene is mutated and thereby its activity and/or the activity or the encoded gene product is repressed, reduced, decreased or deleted. In the event of a random mutagenesis one or more genes are mutated by chance and their activities and/or the activities of their gene products are repressed, reduced, decreased or deleted, preferably decreased or deleted.

For the purpose of a mutagenesis of a huge population of plants, such population can be transformed with a DNA population or a DNA bank, which are useful for the inhibition of as much as possible genes of a plant, preferably all genes. With this method it is possible to statistically mutagenize nearly all genes of a plant by the integration of an advantageously identified DNA-fragment. Afterwards the skilled worker can easily identify the knocked out event. For the mutagenesis of plants EMS, T-DNA and/or transposon mutagenesis is preferred.

In the event of a random mutagenesis a huge number of plants are treated with a mutagenic agent. The amount of said agent and the intensity of the treatment will be chosen in such a manner that statistically nearly every gene is mutated. The process for the random mutagenesis as well as the respective agents is well known by the skilled person. Such methods are disclosed for example by A. M. van Harten [(1998), "Mutation breeding: theory and practical applications", Cambridge University Press, Cambridge, UK], E Friedberg, G Walker, W Siede [(1995), "DNA Repair and Mutagenesis", Blackwell Publishing], or K. Sankaranarayanan, J. M. Gentile, L. R. Ferguson [(2000) "Protocols in Mutagenesis", Elsevier Health Sciences]. As the skilled worker knows the spontaneous mutation rate in the cells of an organism is very low and that a large number of chemical, physical or biological agents are available for the mutagenesis of organisms. These agents are named as mutagens or mutagenic agents. As mentioned before three different kinds of mutagens chemical, physical or biological agents are available.

There are different classes of chemical mutagens, which can be separated by their mode of action. For example base analogues such as 5-bromouracil, 2-amino purin. Other chemical mutagens are interacting with the DNA such as sulphuric acid, nitrous acid, hydroxylamine; or other alkylating agents such as monofunctional agents like ethyl methanesulfonate (=EMS), dimethylsulfate, methyl methanesulfonate, bifunctional like dichloroethyl sulphide, Mitomycin, Nitrosoguanidine-dialkylnitrosamine, N-Nitrosoguanidin derivatives, N-alkyl-N-nitro-N-nitroso-guanidine, intercalating dyes like Acridine, ethidium bromide.

Physical mutagens are for example ionizing irradiation (X-ray), UV irradiation. Different forms of irradiation are available and they are strong mutagens. Two main classes of irradiation can be distinguished: a) non-ionizing irradiation such as UV light or ionizing irradiation such as X-ray. Biological mutagens are for example transposable elements for example IS elements such as IS100, transposons such as Tn5, Tn10, Tn903, Tn916 or Tn1000 or phages like Mu$^{amplac}$, P1, T5, λplac etc. Methods for introducing this phage DNA into the appropriate microorganism are well known to the skilled worker (see Microbiology, Third Edition, Eds. Davis, B. D., Dulbecco, R., Eisen, H. N. and Ginsberg, H. S., Harper International Edition, 1980). The common procedure of a transposon mutagenesis is the insertion of a transposable element within a gene or nearby for example in the promotor or terminator region and thereby leading to a loss of the gene function. Procedures to localize the transposon within the genome of the organisms are well known by a person skilled in the art. For transposon mutagenesis in plants the maize transposon systems Activator-Dissociation (Ac/Ds) and Enhancer-Suppressor mutator (En/Spm) are known to the worker skilled in the art but other transposon systems might be similarly useful. The transposons can be brought into the plant genomes by different available standard techniques for plant transformations. Another type of biological mutagenesis in plants includes the T-DNA mutagenesis, meaning the random integration of T-DNA sequences into the plant genome [Feldmann, K. A. (1991) T-DNA insertion mutagenesis in *Arabidopsis*: Mutational spectrum. Plant J. 1, 71-82]. The event in which the gene of interest is mutated can later be searched by PCR- or other high throughput technologies [Krysan et al., (1999) T_DNA as an insertional mutagen in *Arabidopsis, Plant Cell,* 11, 2283-2290].

Another very efficient method is the introduction of mutations into the genome of bacteria with the aid of transposons (=Tn). Transposons have some common properties, which make them useful as tool for the mutagenesis. Such properties are for example ubiquitous finding in nature for example they are found on chromosomes, plasmids and phages. The transposition of the transposons in the genome is rec-independent and has a general frequency of $10^{-4}$-$10^{-7}$. Transposons are in the possession of an encoded transposase and inverted terminal repeats at their ends. Furthermore they need for integration in the genome a minimal target sequence specificity, bordering on random. Like plasmids they often confer antibiotic resistance. As an advantage they generate polar mutations. Three kinds of transposons are distinguished from one another a) conservative transposons: copy number doesn't increase upon transposition; b) replicative transposons: transposon is copied upon transposition resulting in two copies and c) conjugative transposons: transposon encodes Tra functions, excises and transfers to another host. As the skilled worker knows methods have been developed which facilitate the introduction of transposable elements into a wide variety of both gram negative and gram positive bacteria. Therefore transposable elements can be introduced into the genome of nearly every bacteria. They insert somewhat randomly thus causing insertion mutations. Since the average bacterial species has approximately 3000 genes, one can saturate the chromosome with ease. Furthermore, the transposon provides a molecular tag, which can be subsequently used to identify the mutated gene and clone it. In combination with genomics, transposons are a powerful approach to mutate distinct genes. As mentioned before there are many different methods to introduce transposons into bacteria. The choice will depend on the nature of the target bacterium. Transposons can be introduced into the genome of a bacteria for example with the aid of a temperature-sensitive replicon, a so called bump plasmid by introduction of an incompatible replicon, a transfer plasmid lacking essential replication protein supplied in trans in donor cell or phage that lacks replication in the host organism. Typically well known transposons are Tn5, Tn10, Tn903, Tn916, Tn1000 etc.

Other methods are for example the introduction of mutation with the aid of viruses such as bacteriophages such as P1, P22, T2, T3, T5, T7, Mu$^{amplac}$, Mu, Mu1, MuX, miniMu, λ, λplac or insertion elements such as IS3, IS 100, IS900 etc. Again the whole genome of the bacteria is randomly mutagenized. Mutants can be easily identified.

Another method to disrupt the nucleic acid sequence of the invention and thereby reducing, decreasing or deleting the biological activity of the encoded polypeptide can be reached by homologous recombination with an altered nucleic acid sequence of the invention. The nucleic acid sequences of the invention can therefore be altered by one or more point mutations, deletions, or inversions, but still encodes a functional protein of the invention or a non-functional protein. In another embodiment of the invention, one or more of the regulatory regions (e.g., a promoter, repressor, or inducer) of the gene encoding the protein of the invention has been altered (e.g., by deletion, truncation, inversion, or point mutation) such that the expression of the corresponding gene is modulated that means reduced, decreased or deleted.

Preferably a chemical or biochemical procedure is used for the mutagenesis of the organisms. A preferred chemical method is the mutagenesis with N-methyl-N-nitro-nitrosoguanidine.

Other biological methods are disclosed by Spee et al. (Nucleic Acids Research, Vol. 21, No. 3, 1993: 777-778). Spee et al. teaches a PCR method using dITP for the random mutagenesis. This method described by Spee et al. was further improved by Rellos et al. (Protein Expr. Purif., 5, 1994: 270-277). The use of an in vitro recombination technique for molecular mutagenesis is described by Stemmer (Proc. Natl. Acad. Sci. USA, Vol. 91, 1994: 10747-10751). Moore et al. (Nature Biotechnology Vol. 14, 1996: 458-467) describe the combination of the PCR and recombination methods for increasing the enzymatic activity of an esterase toward a para-nitrobenzyl ester. Another route to the mutagenesis of enzymes is described by Greener et al. in Methods in Molecular Biology (Vol. 57, 1996: 375-385). Greener et al. use the specific *Escherichia coli* strain XL-1-Red to generate *Escherichia coli* mutants which have increased antibiotic resistance.

In one embodiment, the protein according to the invention or the nucleic acid molecule characterized herein originates from an eukaryotic or prokaryotic organism such as a non-human animal, a plant, a microorganism such as a fungi, a yeast, an alga, a diatom or a bacterium. Nucleic acids, which advantageously can be used in the inventive process originate from plants, for example the family Brassicaceae, in particular the genus *Arabidopsis* and the especially advantageous from the species *Arabidopsis thaliana*. In addition nucleic acid sequences, which advantageously can be used in the inventive process originate from plants such as maize, soja, canola, wheat, barley, triticale, rice, linseed, sunflower or potato. The Accessions corresponding to the SEQ ID NO: 2 of the polypeptide of this invention can be taken from the following table for example. Sequence SEQ ID NO: 2 is deposited under the Genebank Accession number At5g 64410.

| Accession | Organism | SEQ ID NO: Protein |
|---|---|---|
| at5g64410 | *Arabidopsis thaliana* | 2 |
| PIR\|D71430 | *Arabidopsis thaliana* | 4 |
| PIR\|F86233 | *Arabidopsis thaliana* | 6 |
| PIR\|S50773 | *Saccharomyces cerevisiae* | 8 |
| PIR\|S58824 | *Saccharomyces cerevisiae* | 10 |
| PIR\|T01900 | *Arabidopsis thaliana* | 12 |
| PIR\|T05878 | *Arabidopsis thaliana* | 14 |
| PIR\|T08925 | *Arabidopsis thaliana* | 16 |
| PIR\|T38497 | *Schizosaccharomyces pombe* | 18 |
| PIR\|T41655 | *Schizosaccharomyces pombe* | 20 |
| SPTREMBL\|O14411 | *Candida albicans* | 22 |
| SPTREMBL\|Q6TUA0 | *Zea mays* | 24 |
| SPTREMBL\|Q6YUP9 | *Oryza sativa* | 26 |
| SPTREMBL\|Q6Z0P5 | *Oryza sativa* | 28 |
| SPTREMBL\|Q6Z8U6 | *Oryza sativa* | 30 |
| SPTREMBL\|Q6ZCL0 | *Oryza sativa* | 32 |
| SPTREMBL\|Q750H8 | *Ashbya gossypii* | 34 |
| SPTREMBL\|Q75BG1 | *Ashbya gossypii* | 36 |
| SPTREMBL\|Q75CX1 | *Ashbya gossypii* | 38 |
| SPTREMBL\|Q75D67 | *Ashbya gossypii* | 40 |
| SPTREMBL\|Q75LM0 | *Oryza sativa* | 42 |
| SPTREMBL\|Q7F9L4 | *Oryza sativa* | 44 |
| SPTREMBL\|Q7RW19 | *Neurospora crassa* | 46 |
| SPTREMBL\|Q7S189 | *Neurospora crassa* | 48 |
| SPTREMBL\|Q7S4I2 | *Neurospora crassa* | 50 |
| SPTREMBL\|Q7S4Q8 | *Neurospora crassa* | 52 |
| SPTREMBL\|Q7S882 | *Neurospora crassa* | 54 |
| SPTREMBL\|Q7S9V4 | *Neurospora crassa* | 56 |
| SPTREMBL\|Q7SC23 | *Neurospora crassa* | 58 |
| SPTREMBL\|Q7SEW1 | *Neurospora crassa* | 60 |
| SPTREMBL\|Q8H641 | *Oryza sativa* | 62 |
| SPTREMBL\|Q8S2I4 | *Oryza sativa* | 64 |
| SPTREMBL\|Q8WZL3 | *Yarrowia lipolytica* | 66 |
| SPTREMBL\|Q93ZI8 | *Arabidopsis thaliana* | 68 |
| SPTREMBL\|Q940I5 | *Arabidopsis thaliana* | 70 |
| SPTREMBL\|Q9FG72 | *Arabidopsis thaliana* | 72 |
| SPTREMBL\|Q9FJD1 | *Arabidopsis thaliana* | 74 |
| SPTREMBL\|Q9FJD2 | *Arabidopsis thaliana* | 76 |
| SPTREMBL\|Q9LWV0 | *Oryza sativa* | 78 |
| SPTREMBL\|Q9LWW1 | *Oryza sativa* | 80 |
| SPTREMBL\|Q9LWW2 | *Oryza sativa* | 82 |
| SPTREMBL\|Q9P939 | *Schizophyllum commune* | 84 |
| SWISSPROT\|ISP4 SCHPO | *Schizosaccharomyces pombe* | 86 |

Accordingly, in one embodiment, the invention relates to an isolated nucleic acid molecule which comprises a nucleic acid molecule selected from the group consisting of:
a) nucleic acid molecule which encodes a polypeptide comprising the polypeptide shown in, SEQ ID NO: 2
b) nucleic acid molecule comprising the polynucleotide shown in SEQ ID NO: 1;
   nucleic acid molecule comprising a nucleic acid sequence, which, as a result of the degeneracy of the genetic code, can be derived from a polypeptide sequence depicted (b) and having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112;
c) nucleic acid molecule encoding a polypeptide having at least 50% identity with the amino acid sequence of the polypeptide encoded by the nucleic acid molecule of (a) or (c) and having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112;
d) nucleic acid molecule which comprises a polynucleotide, which is obtained by amplifying a cDNA library or a genomic library using the primers in SEQ ID NO: 92 and SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101 and SEQ ID NO: 102,
e) nucleic acid molecule encoding a polypeptide, which is isolated with the aid of monoclonal and/or polyclonal antibodies against a polypeptide encoded by one of the nucleic acid molecules of (a) to (c) and having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112;
f) nucleic acid molecule encoding a polypeptide comprising the consensus sequence shown in SEQ ID NO: 87, SEQ ID NO: 88, SEQ ID NO: 89, SEQ ID NO: 90, SEQ ID NO: 91, SEQ ID NO: 265, SEQ ID NO: 266, SEQ ID NO: 267 or SEQ ID NO: 268 and having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112;

g) nucleic acid molecule encoding a polypeptide having the biological activity represented by the protein as depicted in SEQ ID NO: 2;

h) nucleic acid molecule which is obtainable by screening a suitable library under stringent hybridisation conditions with a probe comprising one of the sequences of the nucleic acid molecule of (a) to (c) or with a fragment of at least 15 nt, preferably 20 nt, 30 nt, 50 nt, 100 nt, 200 nt or 500 nt of the nucleic acid molecule characterized in (a) to (i) and encoding a polypeptide having the biological activity represented by the protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112;

i) or which comprises a sequence which is complementary thereto; whereby the nucleic acid molecule according to (a) to (j) is at least in one or more nucleotides different from the sequence depicted in SEQ ID NO: 1 and/or which encodes a protein which differs at least in one, two, three, four, five, six, seven, eight, nine, ten or more amino acids from the protein sequences depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112.

In a further embodiment, the nucleic acid molecule of the present invention is at least 30% identical to the nucleic acid sequence depicted in SEQ ID NO: 1 and less than 100%, preferably less than 99.999%, 99.99% or 99.9%, more preferably less than 99%, 985, 97%, 96% or 95% identical to the sequence shown in SEQ ID NO: 1. Preferably, the nucleic acid molecule also does not encode a polypeptide as shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112.

In another embodiment, the nucleic acid molecule depicted in SEQ ID NO: 1 does not encode a protein of the sequence shown in, SEQ ID NO: 2. That means the protein sequences depicted in SEQ ID NO: 2 does not consist of the sequence shown in SEQ ID NO: 2. In a further embodiment, the protein of the present invention is at least 30% identical to protein sequence depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112 and less than 100%, preferably less than 99.999%, 99.99% or 99.9%, more preferably less than 99%, 985, 97%, 96% or 95% identical to the sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112.

The nucleic acid sequences used in the process are advantageously introduced in a nucleic acid construct, preferably an expression cassette, which allows the reduction, depression etc. of the nucleic acid molecules in a plant.

Accordingly, the invention also relates to a nucleic acid construct, preferably to an expression construct, comprising the nucleic acid molecule of the present invention or a fragment thereof functionally linked to one or more regulatory elements or signals.

As described herein, the nucleic acid construct can also comprise further genes, which are to be introduced into the plant or plant cells. It is possible and advantageous to introduce into, and express in, the host plant regulatory genes such as genes for inductors, repressors or enzymes, which, owing to their enzymatic activity, engage in the regulation of one or more genes of a biosynthetic pathway or in regulation of gene expression or modification of metabolism. These genes can be of heterologous or homologous origin. Moreover, further biosynthesis genes may advantageously be present, or else these genes may be located on one or more further nucleic acid constructs. Genes, which are advantageously additionally employed as plant growth increasing genes are transcription factors, general signaling components like kinases and phosphateses, cell cycle and cell cycle related genes, genes involved in the production and reception of phytohormes and genes of the amino acid metabolism, of glycolysis, of the tricarboxylic acid metabolism or their combinations.

As described herein, regulator sequences or factors can have a positive effect on preferably the gene expression of the genes introduced, thus increasing it. Thus, an enhancement of the regulator elements may advantageously take place at the transcriptional level by using strong transcription signals such as promoters and/or enhancers. In addition, however, an enhancement of translation is also possible, for example by increasing RNA stability. On the other hand the nucleic acid molecules of the invention and the gene products are reduced, decreased or deleted to increase the plant growth as described by the invention.

In principle, the nucleic acid construct can comprise the herein described regulator sequences and further sequences relevant for the reduction of the expression of nucleic acid molecules of the invention and on the other side for the expression of additional genes in the construct. Thus, the nucleic acid construct of the invention can be used as expression cassette and thus can be used directly for introduction into the plant, or else they may be introduced into a vector. Accordingly in one embodiment the nucleic acid construct is an expression cassette comprising a microorganism promoter or a microorganism terminator or both. In another embodiment the expression cassette encompasses a plant promoter or a plant terminator or both.

Accordingly, in one embodiment, the process according to the invention comprises the following steps:
1. introduction of a nucleic acid construct comprising the nucleic acid molecule of the invention, which encodes the polypeptide of the present invention;
or
2. introduction of a nucleic acid molecule, including regulatory sequences or factors, which expression decreases the expression of the polypeptide of the invention;
in a plant cell, a plant tissue, a plant or a plant part thereof, and
3. repressing the polypeptide encoded by the nucleic acids of the invention by the nucleic acid construct or the nucleic acid molecule mentioned under (a) or (b) in the cell or the plant.

After the introduction and expression of the nucleic acid construct the transgenic plant, preferably a crop plant, or a part thereof, or plant cell or tissue is advantageously cultured and subsequently harvested.

To introduce a nucleic acid molecule for example an RNAi, antisense nucleic acid sequence or a mutagenized nucleic acid sequence into a nucleic acid construct, e.g. as part of an expression cassette, which leads to a reduced activity and/or expression of the respective gene, the codogenic gene segment or a part of it or the untranslated regions are as advantageously subjected to an amplification and ligation reaction in the manner known by a skilled person. It is preferred to follow a procedure similar to the protocol for the Pfu DNA polymerase or a Pfu/Taq DNA polymerase mixture. The primers are selected according to the sequence to be amplified. Additional possibilities include the 5' or 3' untranslated regions or the promoter region. After the amplification, the amplificate is expediently analyzed. For example, the analysis may consider quality and quantity and be carried out following separation by gel electrophoresis. Thereafter, the amplificate can be purified following a standard protocol (for example Qiagen). An aliquot of the purified amplificate is then available for the subsequent cloning step. Suitable cloning vectors are generally known to the skilled worker [Cloning Vectors (Eds. Pouwels P. H. et al. Elsevier, Amsterdam-New York-Oxford, 1985, SBN 0 444 904018)].

They include, in particular, vectors which are capable of replication in easy to handle cloning systems like bacterial yeast or insect cell based (e.g. baculovirus expression) systems, that is to say especially vectors which ensure efficient cloning in *E. coli*, and which make possible the stable transformation of plants. Vectors, which must be mentioned, in particular are various binary and cointegrated vector systems, which are suitable for the T-DNA-mediated transformation. Such vector systems are generally characterized in that they contain at least the vir genes, which are required for the *Agrobacterium*-mediated transformation, and the T-DNA border sequences.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those, which are preferably used in accordance with the invention, are Bin19, pBl101, pBinAR, pSun, pGPTV and pCAMBIA or pHELLESGATE. An overview of binary vectors and their use is given by Hellens et al, Trends in Plant Science (2000) 5, 446-451.

For a vector preparation, vectors may first be linearized using restriction endonuclease(s) and then be modified enzymatically in a suitable manner. Thereafter, the vector is purified, and an aliquot is employed in the cloning step. In the cloning step, the enzyme-cleaved and, if required, purified amplificate is cloned together with similarly pre-pared vector fragments, using ligase. In this context, a specific nucleic acid construct, or vector or plasmid construct, may have one or else more codogenic or non codogenic gene segments. The gene segments in these constructs are preferably linked operably to regulatory sequences. The regulatory sequences include, in particular, plant sequences like the above-described promoters and terminators. The constructs can advantageously be propagated stably in microorganisms, in particular *Escherichia coli* and/or *Agrobacterium tumefaciens*, under selective conditions and enable the transfer of heterologous DNA into plants or other microorganisms. In accordance with a particular embodiment, the constructs are based on binary vectors (overview of a binary vector Hellens et al., 2000). As a rule, they contain prokaryotic regulatory sequences, such as replication origin and selection markers, for the multiplication in microorganisms such as *Escherichia coli* and *Agrobacterium tumefaciens*. Vectors can further contain agrobacterial T-DNA sequences for the transfer of DNA into plant genomes or other eukaryotic regulatory sequences for transfer into other eukaryotic cells, e.g. *Saccharomyces* sp. For the transformation of plants, at least the right border sequence, which comprises approximately 25 base pairs, of the total agrobacterial T-DNA sequence is required. Usually, the plant transformation vector constructs according to the invention contain T-DNA sequences both from the right and from the left border region, which contain expedient recognition sites for site-specific acting enzymes, which, in turn, are encoded by some of the vir genes.

Advantageously preferred in accordance with the invention are host organisms of the genus *Agrobacterium tumefaciens* or plants. Preferred plants are selected from among the families Aceraceae, Anacardiaceae, Apiaceae, Asteraceae, Apiaceae, Betulaceae, Boraginaceae, Brassicaceae, Bromeliaceae, Cactaceae, Caricaceae, Caryophyllaceae, Cannabaceae, Convolvulaceae, Chenopodiaceae, Elaeagnaceae, Geraniaceae, Gramineae, Juglandaceae, Lauraceae, Leguminosae, Linaceae, Cucurbitaceae, Cyperaceae, Euphorbiaceae, Fabaceae, Malvaceae, Nymphaeaceae, Papaveraceae, Rosaceae, Salicaceae, Solanaceae, Arecaceae, Iridaceae, Liliaceae, Orchidaceae, Gentianaceae, Labiaceae, Magnoliaceae, Ranunculaceae, Carifolaceae, Rubiaceae, Scrophulariaceae, Ericaceae, Polygonaceae, Violaceae, Juncaceae, Poaceae, perennial grass, fodder crops, vegetables and ornamentals.

Especially preferred are plants selected from the groups of the families Apiaceae, Asteraceae, Brassicaceae, Cucurbitaceae, Fabaceae, Papaveraceae, Rosaceae, Solanaceae, Liliaceae or Poaceae. Especially advantageous are, in particular, crop plants. Accordingly, an advantageous plant preferably belongs to the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassaya, potato, sugarbeet, fodder beet, egg plant, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, alfalfa, dwarf bean, lupin, clover and luceme. Further preferred plants are mentioned above.

In order to introduce, into a plant, the nucleic acid molecule of the invention or used in the process according to the invention for example an RNAi, antisense nucleic acid sequence or a mutagenized nucleic acid sequence, it has proved advantageous first to transfer them into an intermediate host, for example a bacterium or a eukaryotic unicellular cell. The transformation into *E. coli*, which can be carried out in a manner known per se, for example by means of heat shock or electroporation, has proved itself expedient in this context. Thus, the transformed *E. coli* colonies can be analysed for their cloning efficiency. This can be carried out with the aid of a PCR. Here, not only the identity, but also the integrity, of the plasmid construct can be verified with the aid of a defined colony number by subjecting an aliquot of the colonies to said PCR. The amplificates are separated by electrophoresis and assessed with regard to quantity and quality.

The nucleic acid constructs, which are optionally verified, are subsequently used for the transformation of the plants or other hosts, e.g. other eukaryotic cells or other prokaryotic cells. To this end, it may first be necessary to obtain the constructs from the intermediate host. For example, the constructs may be obtained as plasmids from bacterial hosts by a method similar to conventional plasmid isolation.

Gene silencing in plants can advantageously achieved by transient transformation technologies, meaning that the nucleic acids are preferably not integrated into the plant genome. Suitable systems for transient plant transformations are for example agrobacterium based and plant virus based systems. Details about virus based transient systems and their use for gene silencing in plants have been described in Lu et al. in Methods 2003, 30(4) 296-303. The use of *agrobacterium* for the transient expression of nucleic acids in plants have been described for example by Fuentes et al., 2003 in Biotechnol Appl Biochem. 2003 Nov. 21 online: doi: 10.1042/BA20030192.

A large number of methods for the transformation of plants are known. Since, in accordance with the invention, a stable integration of heterologous DNA into the genome of plants is advantageous, the T-DNA-mediated transformation has proved expedient in particular. For this purpose, it is first necessary to transform suitable vehicles, in particular *agrobacteria*, with a gene segment or the corresponding plasmid construct comprising the nucleic acid molecule of the invention. This can be carried out in a manner known per se. For example, said nucleic acid construct of the invention, or said expression, antisense or RNAi construct or said plasmid construct, which has been generated in accordance with what has been detailed above, can be transformed into competent *agrobacteria* by means of electroporation or heat shock. In principle, one must differentiate between the formation of cointegrated vectors on the one hand and the transformation with binary vectors on the other hand. In the case of the first alternative, the constructs, which comprise the codogenic gene segment or the nucleic acid molecule of the invention have no T-DNA sequences, but the formation of the cointegrated vectors or constructs takes place in the *agrobacteria* by homologous recombination of the construct with T-DNA. The T-DNA is present in the *agrobacteria* in the form of Ti or Ri plasmids in which exogenous DNA has expediently replaced the oncogenes. If binary vectors are used, they can be transferred to *agrobacteria* either by bacterial conjugation or by direct transfer. These *agrobacteria* expediently already comprise the vector bearing the vir genes (currently referred to as helper Ti(Ri) plasmid).

In addition the stable transformation of plastids is of advantageous because plastids are inherited maternally in most crops reducing or eliminating the risk of transgene flow through pollen. The process of the transformation of the chloroplast genome is generally achieved by a process which has been schematically displayed in Klaus et al., 2004, Nature Biotechnology 22(2), 225-229).

Briefly the sequences to be transformed are cloned together with a selectable marker gene between flanking sequences homologous to the chloroplast genome. These homologous flanking sequences direct site specific intergration into the plastome. Plastidal transformation has been described for many different plant species and an overview can be taken from Bock et al. [(2001) Transgenic plastids in basic research and plant biotechnology. J Mol Biol. 2001 Sep. 21; 312(3): 425-38] or Maliga, P [Progress towards commercialization of plastid transformation technology. Trends Biotechnol. 21, 20-28 (2003)]. Further biotechnological progress has recently been reported in form of marker free plastid transformants, which can be produced by a transient cointegrated maker gene [Klaus et al., 2004, Nature Biotechnology 22(2), 225229].

One or more markers may expediently also be used together with the nucleic acid construct, or the vector of the invention and, if plants or plant cells shall be transformed together with the T-DNA, with the aid of which the isolation or selection of transformed organisms, such as *agrobacteria* or transformed plant cells, is possible. These marker genes enable the identification of a successful transfer of the nucleic acid molecules according to the invention via a series of different principles, for example via visual identification with the aid of fluorescence, luminescence or in the wavelength range of light which is discernible for the human eye, by a resistance to herbicides or antibiotics, via what are known as nutritive markers (auxotrophism markers) or antinutritive markers, via enzyme assays or via phytohormones. Examples of such markers which may be mentioned are GFP (=green fluorescent protein); the luciferin/luceferase system, the β-galactosidase with its colored substrates, for example X-Gal, the herbicide resistances to, for example, imidazolinone, glyphosate, phosphinothricin or sulfonylurea, the antibiotic resistances to, for example, bleomycin, hygromycin, streptomycin, kanamycin, tetracyclin, chloramphenicol, ampicillin, gentamycin, geneticin (G418), spectinomycin or blasticidin, to mention only a few, nutritive markers such as the utilization of mannose or xylose, or antinutritive markers such as the resistance to 2-deoxyglucose. This list is a small number of possible markers. The skilled worker is very familiar with such markers. Different markers are preferred, depending on the organism and the selection method.

As a rule, it is desired that the plant nucleic acid constructs be flanked by T-DNA at one or both sides of the gene segment. This is particularly useful when bacteria of the species *Agrobacterium tumefaciens* or *Agrobacterium rhizogenes* are used for the transformation. A method, which is preferred in accordance with the invention, is the trans-formation with the aid of *Agrobacterium tumefaciens*. However, biolistic methods may also be used advantageously for introducing the sequences in the process according to the invention, and the introduction by means of PEG is also possible. The transformed *agrobacteria* can be grown in the manner known per se and are thus available for the expedient transformation of the plants. The plants or plant parts to be transformed are grown or provided in the customary manner. The transformed *agrobacteria* are subsequently allowed to act on the plants or plant parts until a sufficient transformation rate is reached. Allowing the *agrobacteria* to act on the plants or plant parts can take different forms. For example, a culture of morphogenic plant cells or tissue may be used. After the T-DNA transfer, the bacteria are, as a rule, eliminated by antibiotics, and the regeneration of plant tissue is induced. This is done in particular using suitable plant hormones in order to initially induce callus formation and then to promote shoot development.

The transfer of nucleic acid constructs into the genome of a plant is called transformation. In doing this the methods described for the transformation and regeneration of plants from plant tissues or plant cells are utilized for transient or stable transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least the flower primordia. The plant is subsequently grown on until the seeds of the treated plant are obtained (Clough and Bent, Plant J. (1998) 16, 735-743). To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Further advantageous transformation methods, in particular for plants, are known to the skilled worker and are described hereinbelow.

A further advantageously suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequences mentioned in SEQ ID NO: 1 and SEQ ID NO: 113 or its derivatives, it is advantageous additionally to express and/or mutate further genes in the organisms. It is also possible that the regulation of the natural genes has been modified advantageously so that the gene and/or its gene product is no longer subject to the regulatory mechanisms which exist in the organisms. This leads to an increased growth desired since, for example, feedback regulations no longer exist to the same extent or not at all. In addition it might be advantageously to combine the sequences SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111 or SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287 which are reduced in the biological activity, with genes which generally support or enhance the growth or yield of the target organism, for example genes which lead to faster a growth rate or genes which for example produces stress-, pathogen, or herbicide resistant plants.

In a further embodiment of the process of the invention, therefore, organisms are grown, in which there is simultaneous overexpression of at least one nucleic acid or one of the genes which code for proteins selected from the group of gene products consisting of aspartate kinase (lysC), of aspartate-semialdehyde dehydrogenase (asd), of glyceraldehyde-3-phosphate dehydrogenase (gap), of 3-phosphoglycerate kinase (pgk), of pyruvate carboxylase (pyc), of triosephosphate isomerase (tpi), of homoserine O-acetyltransferase (metA), of cystathionine γ-synthase (metB), of cystathionine gamma-lyase (metC), cystathionine β-lyase, of methionine synthase (metH), of serine hydroxymethyltransferase (glyA), of O-acetylhomoserine sulfhydrylase (metY), of methylene-tetrahydrofolate reductase (metF), of phosphoserine aminotransferase (serC), of phosphoserine phosphatase (serB), of serine acetyltransferase (cysE), of cysteine synthase (cysK), of homoserine dehydrogenase (hom) and S-adenosylmethionine synthase (metX).

A further advantageous nucleic acid sequence, which can be expressed in combination with the sequences used in the process and/or the abovementioned biosynthesis genes is the sequence of the ATP/ADP translocator as described in WO 01/20009. This ATP/ADP translocator leads to an increased synthesis of the essential amino acids lysine and/or methionine.

In a further advantageous embodiment of the process of the invention, the organisms used in the process are those in which simultaneously at least one of the aforementioned genes or one of the aforementioned nucleic acids is mutated so that the activity of the corresponding proteins is influenced by metabolites to a smaller extent compared with the unmutated proteins, or not at all, and that in particular the transport of oligopeptides according to the invention is not impaired, or so that their specific enzymatic activity is increased. This increased activity of the genes, which are expressed in addition to the reduced, decreased or deleted activities of the nucleic acid sequences of the invention, leads to an increased plant growth. Less influence means in this connection that the regulation of the enzymic activity is less by at least 10%, advantageously at least 20, 30 or 40%, particularly advantageously by at least 50, 60 or 70%, compared with the starting organism, and thus the activity of the enzyme is increased by these figures mentioned compared with the starting organism. An increase in the enzymatic activity means an enzymatic activity which is increased by at least 10%, advantageously at least 20, 30 or 40%, particularly advantageously by at least 50, 60 or 70%, compared with the starting organism. This leads to an increased plant growth.

In a further advantageous embodiment of the process of the invention, the organisms used in the process are those in which simultaneously at least one of the genes selected from homoserine kinase (thrB), threonine dehydratase (ilvA), threonine synthase (thrC), meso-diaminopimelate D-dehydrogenase (ddh), phosphoenolpyruvate carboxykinase (pck), glucose-6-phosphate 6-isomerase (pgi), pyruvate oxidase (poxB), dihydrodipicolinate synthase (dapA), dihydrodipicolinate reductase (dapB) and diaminopicolinate decarboxylase (lysA) or a threonin degrading protein is attenuated, in particular by reducing the rate of expression of the corresponding gene.

In another embodiment of the process of the invention, the organisms used in the process are those in which simultaneously at least one of the aforementioned nucleic acids or of the aforementioned genes is mutated in such a way that the enzymatic activity of the corresponding protein is partially reduced or completely blocked. A reduction in the enzymatic activity means an enzymatic activity, which is reduced by at least 10%, advantageously at least 20, 30 or 40%, particularly advantageously by at least 50, 60 or 70%, preferably more, compared with the starting organism.

If it is intended to transform the host cell, in particular the plant cell, with several constructs or vectors, the marker of a preceding transformation must be removed or a further marker employed in a following transformation. The markers can be removed from the host cell, in particular the plant cell, as described hereinbelow via methods with which the skilled worker is familiar. In particular plants without a marker, in particular without resistance to antibiotics, are an especially preferred embodiment of the present invention.

In the process according to the invention, the nucleic acid sequences used in the process according to the invention are advantageously linked operably to one or more regulatory signals in order to increase gene expression for example if RNAi or antisense is used. These regulatory sequences are intended to enable the specific expression of the genes or gene fragments. Depending on the host organism for example plant or microorganism, this may mean, for example, that the gene or gene fragment is expressed and/or overexpressed after induction only, or that it is expressed and/or overexpressed constitutive. These regulatory sequences are, for example, sequences to which the inductors or repressors bind and which thus regulate the expression of the nucleic acid. In addition to these novel regulatory sequences, or instead of these sequences, the natural regulation of these sequences may still be present before the actual structural genes and, if appropriate, may have been genetically modified so that the natural regulation has been switched off and gene expression has been increased. However, the nucleic acid construct of the invention suitable as expression cassette (=expression construct=gene construct) can also be simpler in construction, that is to say no additional regulatory signals have been inserted before the nucleic acid sequence or its derivatives, and the natural promoter together with its regulation has not been removed. Instead, the natural regulatory sequence has been mutated in such a way that regulation no longer takes place and/or gene expression is increased. These modified promoters can also be introduced on their own before the natural gene in the form of part sequences (=promoter with parts of the nucleic acid sequences according to the invention) in order to increase the activity. Moreover, the gene construct can advantageously also comprise one or more of what are known as enhancer sequences in operable linkage with the promoter, and these enable an increased expression of the nucleic acid sequence. Also, it is possible to insert additional advantageous sequences at the 3' end of the DNA sequences, such as, for example, further regulatory elements or terminators.

The nucleic acid molecules, which encode proteins according to the invention and nucleic acid molecules, which encode other polypeptides may be present in one nucleic acid construct or vector or in several ones. Advantageously, only one copy of the nucleic acid molecule of the invention or its encoding genes is present in the nucleic acid construct or vector. Several vectors or nucleic acid construct or vector can be expressed together in the host organism. The nucleic acid molecule or the nucleic acid construct or vector according to the invention can be inserted in a vector and be pre-sent in the cell in a free form. If a stable transformation is preferred, a vector is used, which is stably duplicated over several generations or which is else be inserted into the genome. In the case of plants, integration into the plastid genome or, in particular, into the nuclear genome may have taken place. For the insertion of more than one gene in the host genome the genes to be expressed are present together in one gene construct, for example in above-described vectors bearing a plurality of genes.

As a rule, regulatory sequences for the expression rate of a gene are located upstream (5'), within, and/or downstream (3') relative to the coding sequence of the nucleic acid molecule of the invention or another codogenic gene segment. They control in particular transcription and/or translation and/or the transcript stability. The expression level is dependent on the conjunction of further cellular regulatory systems, such as the protein biosynthesis and degradation systems of the cell.

Regulatory sequences include transcription and translation regulating sequences or signals, e.g. sequences located upstream (5'), which concern in particular the regulation of transcription or translation initiation, such as promoters or start codons, and sequences located downstream (3'), which concern in particular the regulation of transcription or translation termination and transcript stability, such as polyadenylation signals or stop codons. Regulatory sequences can also be present in transcribed coding regions as well in transcribed non-coding regions, e.g. in introns, as for example splicing sites.

Promoters for the regulation of expression of the nucleic acid molecule according to the invention in a cell and which can be employed are, in principle, all those which are capable of reducing the transcription of the nucleic acid molecules or stimulating the transcription of additional genes in the organisms in question, such as microorganisms or plants, depending on the goal, which should be reached by using said promotors. Suitable promoters, which are functional in these organisms, are generally known. They may take the form of constitutive or inducible promoters. Suitable promoters can enable the development- and/or tissue-specific expression in multi-celled eukaryotes; thus, leaf-, root-, flower-, seed-, stomata-, tuber- or fruit-specific promoters may advantageously be used in plants.

Promoters, which are particularly advantageous, are constitutive, tissue or compartment specific and inducible promoters. In general, "promoter" is understood as meaning, in the present context, a regulatory sequence in a nucleic acid molecule, which mediates the expression of a coding sequence segment of a nucleic acid molecule. In general, the promoter is located upstream to the coding sequence segment. Some elements, for example expression-enhancing elements such as enhancer may, however, also be located downstream or even in the transcribed region.

In principle, it is possible to use natural promoters together with their regulatory sequences, such as those mentioned above, for the novel process. It is also possible advantageously to use synthetic promoters, either additionally or alone, in particular when they mediate seed-specific expression such as described in, for example, WO 99/16890.

The expression of the nucleic acid molecules used in the process may be desired alone or in combination with other genes or nucleic acids. Multiple nucleic acid molecules conferring repression or expression of advantageous genes, depending on the goal to be reached, can be introduced via the simultaneous transformation of several individual suitable nucleic acid constructs, i.e. expression constructs, or, preferably, by combining several expression cassettes on one construct. It is also possible to transform several vectors with in each case several expression cassettes stepwise into the recipient organism.

As described above, the transcription of the genes, which are in addition to the genes of the invention introduced should advantageously be terminated by suitable terminators at the 3' end of the biosynthesis genes introduced (behind the stop codon). A terminator, which may be used for this purpose is, for example, the OCS1 terminator, the nos3 terminator or the 35S terminator. As is the case with the promoters, different terminator sequences should be used for each gene.

Different plant promoters such as, for example, the USP, the LegB4-, the DC3 promoter or the ubiquitin promoter from parsley or other herein mentioned promoter and different terminators may advantageously be used in the nucleic acid construct. Further useful plant promoters are for example the maize ubiquitin promoter, the ScBV (Sugarcaine bacilliform virus) promoter, the Ipt2 or Ipt1-gene promoters from barley (WO 95/15389 and WO 95/23230) or those described in WO 99/16890 (promoters from the barley hordein-gene, the rice glutelin gene, the rice oryzin gene, the rice prolamin gene, the wheat gliadin gene, wheat glutelin gene, the maize zein gene, the oat glutelin gene, the *Sorghum kasirin*-gene, the rye secalin gene).

In order to ensure the stable integration, into the transgenic plant, of nucleic acid molecules used in the process according to the invention in combination with further biosynthesis genes over a plurality of generations, each of the coding regions used in the process should be expressed under the control of its own, preferably unique, promoter since repeating sequence motifs may lead to recombination events or to silencing or, in plants, to instability of the T-DNA.

The nucleic acid construct is advantageously constructed in such a way that a promoter is followed by a suitable cleavage site for insertion of the nucleic acid to be expressed, advantageously in a polylinker, followed, if appropriate, by a terminator located behind the polylinker. If appropriate, this order is repeated several times so that several nucleic acid sequences are combined in one construct and thus can be introduced into the transgenic plant in order to be expressed. The sequence is advantageously repeated up to three times. For the expression, the nucleic acid sequences are inserted via the suitable cleavage site, for example in the polylinker behind the promoter. It is advantageous for each nucleic acid sequence to have its own promoter and, if appropriate, its own terminator, as mentioned above. However, it is also possible to insert several nucleic acid sequences behind a promoter and, if appropriate, before a terminator if a polycistronic transcription is possible in the host or target cells. In this context, the insertion site, or the sequence of the nucleic acid molecules inserted, in the nucleic acid construct is not decisive, that is to say a nucleic acid molecule can be inserted in the first or last position in the cassette without this having a substantial effect on the expression. However, it is also possible to use only one promoter type in the construct. However, this may lead to undesired recombination events or silencing effects, as said.

Accordingly, in a preferred embodiment, the nucleic acid construct according to the invention confers expression of the nucleic acid molecule of the invention, and, optionally further genes, in a plant and comprises one or more plant regulatory elements. Said nucleic acid construct according to the invention advantageously encompasses a plant promoter or a plant terminator or a plant promoter and a plant terminator.

A "plant" promoter comprises regulatory elements, which mediate the expression of a coding sequence segment in plant cells. Accordingly, a plant promoter need not be of plant origin, but may originate from viruses or microorganisms, in particular for example from viruses which attack plant cells.

The plant promoter can also originate from a plant cell, e.g. from the plant, which is transformed with the nucleic acid construct or vector as described herein. This also applies to other "plant" regulatory signals, for example in "plant" terminators.

A nucleic acid construct suitable for plant expression preferably comprises regulatory elements which are capable of controlling the expression of genes in plant cells and which are operably linked so that each sequence can fulfill its function. Accordingly, the nucleic acid construct can also comprise transcription terminators. Examples for transcriptional termination are polyadenylation signals. Preferred polyadenylation signals are those which originate from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents thereof, but all the other terminators which are functionally active in plants are also suitable.

The nucleic acid construct suitable for plant expression preferably also comprises other operably linked regulatory elements such as translation enhancers, for example the overdrive sequence, which comprises the tobacco mosaic virus 5'-untranslated leader sequence, which increases the protein/RNA ratio (Gallie et al., 1987, Nucl. Acids Research 15:8693-8711).

For expression in plants, the nucleic acid molecule must, as described above, be linked operably to or comprise a suitable promotor which expresses the gene at the right point in time and in a cell- or tissue-specific manner. Usable promoters are constitutive promoters (Benfey et al., EMBO J. 8 (1989) 2195-2202), such as those which originate from plant viruses, such as 35S CAMV (Franck et al., Cell 21 (1980) 285-294), 19S CaMV (see also U.S. Pat. No. 5,352,605 and WO 84/02913), 34S FMV (Sanger et al., Plant. Mol. Biol., 14, 1990: 433-443), the parsley ubiquitin promoter, or plant promoters such as the Rubisco small subunit promoter described in U.S. Pat. No. 4,962,028 or the plant promoters PRP1 [Ward et al., Plant. Mol. Biol. 22 (1993)], SSU, PGEL1, OCS [Leisner (1988) Proc Natl Acad Sci USA 85(5): 2553-2557], lib4, usp, mas [Comai (1990) Plant Mol Biol 15 (3):373-381], STLS1, ScBV (Schenk (1999) Plant Mol Biol 39(6):1221-1230), B33, SAD1 or SAD2 (flax promoters, Jain et al., Crop Science, 39 (6), 1999: 1696-1701) or nos [Shaw et al. (1984) Nucleic Acids Res. 12(20):7831-7846]. Stable, constitutive expression of the proteins according to the invention in a plant can be advantageous.

However, inducible expression of the polypeptide of the invention is advantageous, if a late expression before the harvest is of advantage, as metabolic manipulation may lead to plant growth retardation.

The expression of plant genes can also be facilitated as described above via a chemical inducible promoter (for a review, see Gatz 1997, Annu. Rev. Plant Physiol. Plant Mol. Biol., 48:89-108). Chemically inducible promoters are particularly suitable when it is desired to express the gene in a time-specific manner. Examples of such promoters are a salicylic acid inducible promoter (WO 95/19443), and abscisic acid-inducible promoter (EP 335 528), a tetracyclin-inducible promoter (Gatz et al. (1992) Plant J. 2, 397-404), a cyclohexanol- or ethanol-inducible promoter (WO 93/21334) or others as described herein.

Other suitable promoters are those which react to biotic or abiotic stress conditions, for example the pathogen-induced PRP1 gene promoter (Ward et al., Plant. Mol. Biol. 22 (1993) 361-366), the tomato heat-inducible hsp80 promoter (U.S. Pat. No. 5,187,267), the potato chill-inducible alpha-amylase promoter (WO 96/12814) or the wound-inducible pinII promoter (EP-A-0 375 091) or others as described herein.

Preferred promoters are in particular those which bring about gene expression in tissues and organs in which the biosynthesis of metabolites takes place, in seed cells, such as endosperm cells and cells of the developing embryo. Suitable promoters are the oilseed rape napin gene promoter (U.S. Pat. No. 5,608,152), the *Vicia faba* USP promoter (Baeumlein et al., Mol Gen Genet, 1991, 225 (3): 459-67), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), the bean arc5 promoter, the carrot DcG3 promoter, or the Legumin B4 promoter (LeB4; Baeumlein et al., 1992, Plant Journal, 2 (2): 233-9), and promoters which bring about the seed-specific expression in monocotyledonous plants such as maize, barley, wheat, rye, rice and the like. Advantageous seed-specific promoters are the sucrose binding protein promoter (WO 00/26388), the phaseolin promoter and the napin promoter. Suitable promoters which must be considered are the barley Ipt2 or Ipt1 gene promoter (WO 95/15389 and WO 95/23230), and the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene and the rye secalin gene). Further suitable promoters are Amy32b, Amy 6-6 and Aleurain [U.S. Pat. No. 5,677,474], Bce4 (oilseed rape) [U.S. Pat. No. 5,530,149], glycinin (soya) [EP 571 741], phosphoenolpyruvate carboxylase (soya) [JP 06/62870], ADR12-2 (soya) [WO 98/08962], isocitrate lyase (oilseed rape) [U.S. Pat. No. 5,689,040] or α-amylase (barley) [EP 781 849]. Other promoters which are available for the expression of genes in plants are leaf-specific promoters such as those described in DE-A 19644478 or light-regulated promoters such as, for example, the pea petE promoter.

Further suitable plant promoters are the cytosolic FBPase promoter or the potato ST-LSI promoter (Stockhaus et al., EMBO J. 8, 1989, 2445), the *Glycine max* phospho-ribosylpyrophosphate amidotransferase promoter (GenBank Accession No. U87999) or the node-specific promoter described in EP-A 0 249 676.

Other promoters, which are particularly suitable, are those resulting in plastid-specific expression. Suitable promoters such as the viral RNA polymerase promoter are described in WO 95/16783 and WO 97/06250, and the *Arabidopsis* cipP promoter, which is described in WO 99/46394.

Other promoters, which are used for the strong expression of nucleic acid sequences in as many tissues as possible, in particular also in leaves, are, in addition to several of the abovementioned viral and bacterial promoters, preferably, plant promoters of actin or ubiquitin genes such as, for example, the rice actin1 promoter. Further examples of constitutive plant promoters are the sugarbeet V-ATPase promoters (WO 01/14572). Examples of synthetic constitutive promoters are the Super promoter (WO 95/14098) and promoters derived from G-boxes (WO 94/12015). If appropriate, chemical inducible promoters may furthermore also be used, compare EP-A 388 186, EP-A 335 528, WO 97/06268.

Another preferred embodiment of the invention is a nucleic acid construct conferring the expression of the dsRNA molecule, the antisense nucleic acid molecule, the ribozyme, the viral nucleic acid molecule or the nucleic acid molecule as used in the inventive process, suitable for the expression in plant.

Preferred recipient plants are, as described above, in particular those plants, which can be transformed in a suitable manner. These include monocotyledonous and dicotyledonous plants. Plants which must be mentioned in particular are agriculturally useful plants such as cereals and grasses, for example *Triticum* spp., *Zea mays*, *Hordeum vulgare*, oats, *Secale cereale*, *Oryza sativa*, *Pennisetum glaucum*, *Sorghum bicolor*, *Triticale*, *Agrostis* spp., *Cenchrus ciliaris*, *Dactylis glomerata*, *Festuca arundinacea*, *Lolium* spp., *Medicago* spp. and *Saccharum* spp., legumes and oil crops, for example *Brassica juncea*, *Brassica napus*, *Glycine max*, *Arachis hypogaea*, *Gossypium hirsutum*, *Cicer arietinum*, *Helianthus annuus*, *Lens culinaris*, *Linum usitatissimum*, *Sinapis alba*, *Trifolium repens* and *Vicia narbonensis*, vegetables and fruits, for example bananas, grapes, *Lycopersicon esculentum*, asparagus, cabbage, watermelons, kiwi fruit, *Solanum tuberosum*, *Beta vulgaris*, cassaya and chicory, trees, for example *Coffea* species, *Citrus* spp., *Eucalyptus* spp., *Picea* spp., *Pinus* spp. and *Populus* spp., medicinal plants and trees, and flowers.

One embodiment of the present invention also relates to a method for generating a vector, which comprises the insertion, into a vector, of the nucleic acid molecule characterized herein, the nucleic acid molecule according to the invention or the expression cassette according to the invention. The vector can, for example, be introduced into a cell, e.g. a microorganism or a plant cell, as described herein for the nucleic acid construct, or below under transformation or transfection or shown in the examples. A transient or stable transformation of the host or target cell is possible, however, a stable transformation is preferred.

The vector according to the invention is preferably a vector, which is suitable for reducing, decreasing or deleting of the polypeptide according to the invention in a plant. The method can thus also encompass one or more steps for integrating regulatory signals into the vector, in particular signals, which mediate the reduction, decrease or deletion in a plant.

Accordingly, the present invention also relates to a vector comprising the nucleic acid molecule characterized herein as part of a nucleic acid construct suitable for plant expression or the nucleic acid molecule according to the invention.

The advantageous vectors of the invention comprise the nucleic acid molecules which encode proteins according to the invention, nucleic acid molecules which are used in the process, or nucleic acid construct suitable for the expression in plants as described above comprising the nucleic acid molecules used, either alone or in combination with further genes such as the biosynthesis or regulatory genes of plant metabolisms e.g. with the genes mentioned herein above. In accordance with the invention, the term "vector" refers to a nucleic acid molecule, which is capable of transporting another nucleic acid to which it is linked. One type of vector is a "plasmid", which means a circular double-stranded DNA loop into which additional DNA segments can be ligated. A further type of vector is a viral vector, it being possible to ligate additional DNA segments into the viral genome. Certain vectors are capable of autonomous replication in a host cell into which they have been introduced (for example bacterial vectors with bacterial replication origin). Other preferred vectors are advantageously completely or partly integrated into the genome of a host cell when they are introduced into the host cell and thus replicate together with the host genome. Moreover, certain vectors are capable of controlling the expression of genes with which they are in operable linkage. In the present context, these vectors are referred to as "expression vectors". As mentioned above, they are capable of autonomous replication or may be integrated partly or completely into the host genome. Expression vectors, which are suitable for DNA recombination techniques usually, take the form of plasmids. In the present description, "plasmid" and "vector" can be used interchangeably since the plasmid is the most frequently used form of a vector. However, the invention is also intended to encompass these other forms of expression vectors, such as viral vectors, which exert similar functions. The term vector is furthermore also to encompass other vectors which are known to the skilled worker, such as phages, viruses such as SV40, CMV, TMV, transposons, IS elements, plasmids, phagemids, cosmids, and linear or circular DNA.

The recombinant expression vectors which are advantageously used in the process comprise the nucleic acid molecules according to the invention or the nucleic acid construct according to the invention in a form which is suitable for repressing the nucleic acid molecules of the invention and/or in the same time expressing, in a host cell, additional genes, which are accompanied by the nucleic acid molecules according to the invention or described herein. Accordingly, the recombinant expression vectors comprise one or more regulatory signals selected on the basis of the host cells to be used for the expression, in operable linkage with the nucleic acid sequence to be expressed.

In a recombinant expression vector, "operable linkage" means that the nucleic acid molecule of interest is linked to the regulatory signals in such a way that expression of the genes is possible: they are linked to one another in such a way that the two sequences fulfill the predicted function assigned to the sequence (for example in an in-vitro transcription/translation system, or in a host cell if the vector is introduced into the host cell).

The term "regulatory sequence" is intended to comprise promoters, enhancers and other expression control elements (for example polyadenylation signals). These regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnology, CRC Press, Boca Raton, Fla., Ed.:. Glick and Thompson, chapter 7, 89-108, including the references cited therein. Regulatory sequences encompass those, which control the constitutive expression of a nucleotide sequence in many types of host cells and those which control the direct expression of the nucleotide sequence in specific host cells only, and under specific conditions. The skilled worker knows that the design of the expression vector may depend on factors such as the selection of the host cell to be transformed, the extent to which the desired protein is expressed, and the like. A preferred selection of regulatory sequences is described above, for example promoters, terminators, enhancers and the like. The term regulatory sequence is to be considered as being encompassed by the term regulatory signal. Several advantageous regulatory sequences, in particular promoters and terminators are described above. In general, the regulatory sequences described as advantageous for nucleic acid construct suitable for expression are also applicable for vectors.

The recombinant expression vectors used can be designed specifically for the expression, in prokaryotic and/or eukaryotic cells, of nucleic acid molecules used in the process. This is advantageous since intermediate steps of the vector construction are frequently carried out in microorganisms for the sake of simplicity. For example, the genes according to the invention and other genes can be expressed in bacterial cells, insect cells (using baculovirus expression vectors), yeast cells and other fungal cells [Romanos (1992), Yeast 8:423-488; van den Hondel, (1991), in: More Gene Manipulations in Fungi, J. W. Bennet & L. L. Lasure, Ed., pp. 396-428: Academic Press: San Diego; and van den Hondel, C. A. M. J. J. (1991), in: Applied Molecular Genetics of Fungi, Peberdy, J. F., et al., Ed., pp. 1-28, Cambridge University Press: Cambridge], algae [Falciatore et al., 1999, Marine Biotechnology. 1, 3:239-251] using vectors and following a transformation method as described in WO 98/01572, and preferably in cells of multi-celled plants [see Schmidt, R. and Willmitzer, L. (1988) Plant Cell Rep.: 583-586; Plant Molecular Biology and Biotechnology, C Press, Boca Raton, Fla., chapter 6/7, pp. 71-119 (1993); F. F. White, in: Transgenic Plants, Bd. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)]. Suitable host cells are furthermore discussed in Goeddel, Gene Expression Technology: Methods in Enzymology 185, Academic Press, San Diego, Calif. (1990). As an alternative, the sequence of the recombinant expression vector can be transcribed and translated in vitro, for example using T7 promotor-regulatory sequences and T7 polymerase.

In most cases, proteins can be expressed in prokaryotes using vectors comprising constitutive or inducible promoters, which control the expression of fusion proteins or nonfusion proteins. Typical fusion expression vectors are, inter alia, pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), in which glutathione-S-transferase (GST), maltose-E-binding protein or protein A is fused with the recombinant target protein. Examples of suitable inducible nonfusion E. coli expression vectors are, inter alia, pTrc (Amann et al. (1988) Gene 69:301-315) and pET 11d [Studier et al., Gene Expression Technology: Methods in Enzymology 185, Academic Press, San Diego, Calif. (1990) 60-89]. The target gene expression of the pTrc vector is based on the transcription of a hybrid trp-lac fusion promoter by the host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) by a resident 1-prophage, which harbors a T7 gn1 gene under the transcriptional control of the lacUV 5 promoter.

Other vectors which are suitable in prokaryotic organisms are known to the skilled worker; these vectors are for example in E. coli pLG338, pACYC184, the pBR series, such as pBR322, the pUC series such as pUC18 or pUC19, the M113 mp series, pKC30, pRep4, pHS1, pHS2, pPLc236, pMBL24, pLG200, pUR290, pIN-III[113]-B1, Igt11 or pBdCl, in Streptomyces pIJ101, pIJ364, pIJ702 or pIJ361, in Bacillus pUB110, pC194 or pBD214, in Corynebacterium pSA77 or pAJ667.

In a further embodiment, the expression vector is a yeast expression vector. Examples of vectors for expression in the yeasts S. cerevisiae encompass pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and methods for the construction of vectors which are suitable for use in other fungi, such as the filamentous fungi, encompass those which are described in detail in: van den Hondel, C. A. M. J. J. [(1991), J. F. Peberdy, Ed., pp. 1-28, Cambridge University Press: Cambridge; or in: More Gene Manipulations in Fungi; J. W. Bennet & L. L. Lasure, Ed., pp. 396-428: Academic Press: San Diego]. Examples of other suitable yeast vectors are 2 µM, pAG1, YEp6, YEp13 or pEMBLYe23.

Further vectors, which may be mentioned by way of example, are pALS1, pIL2 or pBB116 in fungi or pLGV23, pGHlac$^+$, pBIN19, pAK2004 or pDH51 in plants.

The abovementioned vectors are only a small overview of potentially suitable vectors. Further plasmids are known to the skilled worker and are described, for example, in: Cloning Vectors (Ed. Pouwels, P. H., et al., Elsevier, Amsterdam-New York-Oxford, 1985, ISBN 0 444 904018). Further suitable expression systems for prokaryotic and eukaryotic cells, see the chapters 16 and 17 by Sambrook, J., Fritsch, E. F., and Maniatis, T., Molecular Cloning: A Laboratory Manual, 2nd Edition, Cold Spring Harbor Laboratory, Cold Spring Harbor Laboratory Press, Cold Spring Harbor, N.Y., 1989.

Accordingly, one embodiment of the invention relates to a vector comprising the nucleic acid molecule according to the invention or a nucleic acid construct of the invention. Said vector is useful for the reduction, decrease or deletion of the polypeptide according to the invention in an organism preferably a plant. Advantageously the nucleic acid molecule of the invention is in an operable linkage with regulatory sequences for the expression in a prokaryotic or eukaryotic, or in a prokaryotic and eukaryotic host. Furthermore vectors suitable for homologous recombination are also within the scope of the invention.

Accordingly, one embodiment of the invention relates to a host cell, which has been transformed stably or transiently with the vector according to the invention or the nucleic acid molecule according to the invention or the nucleic acid construct according to the invention. Said host cell is preferably a plant cell.

The skilled worker knows that protein and DNA expressed in different organisms differ in many respects and properties, e.g. methylation, degradation and post-translational modification as for example glucosylation, phosphorylation, acetylation, myristoylation, ADP-ribosylation, farnesylation, carboxylation, sulfation, ubiquination, etc. though having the same coding sequence. Preferably, the cellular expression control of the corresponding protein differs accordingly in the control mechanisms controlling the activity and expression of an endogenous protein or another eukaryotic protein.

In one embodiment, the present invention relates to a polypeptide having the biological activity represented by the protein of the invention. In one embodiment, said polypeptide having the biological activity represented by the protein of the invention distinguishes over the sequence depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 by one or more amino acids. In another embodiment, said polypeptide of the invention does not consist of the sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288. In a further embodiment, said polypeptide of the present invention is less than 100%, 99.999%, 99.99%, 99.9% or 99% identical to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288.

In one embodiment, the present invention relates to a polypeptide having the amino acid sequence encoded by a nucleic acid molecule of the invention or obtainable by a process of the invention. Said polypeptide confers preferably the aforementioned activity, in particular, the polypeptide confers the increase of plant growth in a cell, tissue or a plant or a part thereof after decreasing the cellular activity, e.g. by decreasing the expression or the specific activity of the polypeptide. In one embodiment, said polypeptide distinguishes over the sequence depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 by one or more amino acids. Preferably, the sequence of the polypeptide of the invention distinguishes from the sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 by not more than 80% or 70% of the amino acids, preferably not more than 60% or 50%, more preferred not more than 40% or 30%, even more preferred not more than 20% or 10%. In one embodiment, polypeptide distinguishes form the sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 by more than 5, 6, 7, 8 or 9 amino acids, preferably by more than 10, 15, 20, 25 or 30 amino acids, even more preferred are more than 40, 50, or 60 amino acids. In another embodiment, said polypeptide of the invention does not consist of the sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO:

212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288. In a further embodiment, said polypeptide of the present invention is less than 100%, 99.999%, 99.99%, 99.9% or 99% identical.

The terms "protein" and "polypeptide" used in this application are interchangeable. "Polypeptide" refers to a polymer of amino acids (amino acid sequence) and does not refer to a specific length of the molecule. Thus peptides and oligopeptides are included within the definition of polypeptide. This term does also refer to or include posttranslational modifications of the polypeptide, for example, glycosylations, acetylations, phosphorylations and the like. Included within the definition are, for example, polypeptides containing one or more analogs of an amino acid (including, for example, unnatural amino acids, etc.), polypeptides with substituted linkages, as well as other modifications known in the art, both naturally occurring and non-naturally occurring.

Preferably, the polypeptide is isolated. An "isolated" or "purified" protein or nucleic acid molecule or biologically active portion thereof is substantially free of cellular material when produced by recombinant DNA techniques, or chemical precursors or other chemicals when chemically synthesized.

A polypeptide of the invention can participate in the process of the present invention. The polypeptide or a portion thereof comprises preferably an amino acid sequence which is sufficiently homologous to an amino acid sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 such that the protein or portion thereof maintains the ability to confer the activity of the present invention, that means an increase in plant growth by decreasing its biological activity. Preferably, the polypeptide used in the inventive process has an amino acid sequence identical as shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90%, and more preferably at least about 91%, 92%, 93%, 94% or 95%, and even more preferably at least about 96%, 97%, 98%, 99% or more homologous to one of the nucleic acid sequences acids SEQ ID 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285 or SEQ ID NO: 287. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of SEQ ID NO: 1 or SEQ ID NO: 113 or which is homologous thereto, as defined above.

Accordingly the polypeptide of the present invention can vary from SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution, 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of amino acid sequences were used: gap weight: 8, length weight: 2, average match: 2.912, average mismatch: −2.003.

Biologically active portions of an polypeptide of the present invention include peptides comprising amino acid sequences derived from the amino acid sequence of the polypeptide of the present invention, e.g., the amino acid sequence shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288 or the amino acid sequence of a protein homologous thereto, which include fewer amino acids than a full length protein having the biological activity of the protein of the invention or the polypeptide of the present invention or the full length protein which is homologous to a protein having the biological activity of the protein of the invention or the polypeptide of the present invention depicted herein, and exhibit at least one activity of the polypeptide of the present invention, which leads to an increase in yield after reduction of its expression or activity. Typically, biologically (or immunologically) active portions i.e. peptides, e.g., peptides which are, for example, 5, 10, 15, 20, 30, 35, 36, 37, 38, 39, 40, 50, 100 or more amino acids in length comprise a domain or motif with at least one activity or epitope of a or of the polypeptide of the present invention. Moreover, other biologically active portions, in which other regions of the polypeptide are deleted, can be prepared by recombinant techniques and evaluated for one or more of the activities described herein.

Any mutagenesis strategies for the polypeptide of the present invention, which result in a decreasing biological activity disclosed herein are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing mutated nucleic acid molecule and/or polypeptide molecules of the invention such that the yield, production, and/or efficiency of production of a desired compound such as the fine chemical is improved. This desired compound may be any natural product of plants, which includes the final products of biosynthesis pathways and intermediates of naturally-occurring metabolic pathways, as well as molecules which do not naturally occur in the metabolism of said cells, but which are produced by a said cells of the invention.

Furthermore, folding simulations and computer redesign of structural motifs of the protein of the invention can be performed using appropriate computer programs (Olszewski, Proteins 25 (1996), 286-299; Hoffman, Comput. Appl. Biosci. 11 (1995), 675-679). Computer modeling of protein folding can be used for the conformational and energetic analysis of detailed peptide and protein models (Monge, J. Mol. Biol. 247 (1995), 995-1012; Renouf, Adv. Exp. Med. Biol. 376 (1995), 37-45). The appropriate programs can be used for the identification of interactive sites of the polypeptide of the invention and its substrates or binding factors or other interacting proteins by computer assistant searches for complementary peptide sequences (Fassina, Immunomethods (1994), 114-120). Further appropriate computer systems for the design of protein and peptides are described in the prior art, for example in Berry, Biochem. Soc. Trans. 22 (1994), 1033-1036; Wodak, Ann. N.Y. Acad. Sci. 501 (1987), 1-13; Pabo, Biochemistry 25 (1986), 5987-5991. The results obtained from the above-described computer analysis can be used for, e.g., the preparation of peptidomimetics of the protein of the invention or fragments thereof. Such pseudopeptide analogues of the natural amino acid sequence of the protein may very efficiently mimic the parent protein (Benkirane, J. Biol. Chem. 271 (1996), 33218-33224). For example, incorporation of easily available achiral Q-amino acid residues into a protein of the invention or a fragment thereof results in the substitution of amide bonds by polymethylene units of an aliphatic chain, thereby providing a convenient strategy for constructing a peptidomimetic (Banerjee, Biopolymers 39 (1996), 769-777).

Superactive peptidomimetic analogues of small peptide hormones in other systems are described in the prior art (Zhang, Biochem. Biophys. Res. Commun. 224 (1996), 327-331). Appropriate peptidomimetics of the protein of the present invention can also be identified by the synthesis of peptidomimetic combinatorial libraries through successive amide alkylation and testing the resulting compounds, e.g., for their binding and immunological properties. Methods for the generation and use of peptidomimetic combinatorial libraries are described in the prior art, for example in Ostresh, Methods in Enzymology 267 (1996), 220-234 and Dorner, Bioorg. Med. Chem. 4 (1996), 709-715.

Furthermore, a three-dimensional and/or crystallographic structure of the protein of the invention can be used for the design of peptidomimetic inhibitors of the biological activity of the protein of the invention (Rose, Biochemistry 35 (1996), 12933-12944; Rutenber, Bioorg. Med. Chem. 4 (1996), 1545-1558).

Furthermore, a three-dimensional and/or crystallographic structure of the protein of the invention and the identification of interactive sites the polypeptide of the invention and its substrates or binding factors can be used for design of mutants with modulated binding or turn over activities. For example, the active center of the polypeptide of the present invention can be modelled and amino acid residues participating in the catalytic reaction can be modulated to increase or decrease the binding of the substrate to inactivate the polypeptide. The identification of the active center and the amino acids involved in the catalytic reaction facilitates the screening for mutants having an increased activity.

The sequence shown in SEQ ID NO: 2 has been described under its Accession Number At5g64410 or NP_201246 as a protein of the OPT oligopeptide transporter protein family. Homologues of this protein are depicted in SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 104, SEQ ID NO: 106, SEQ ID NO: 108, SEQ ID NO: 110 or SEQ ID NO: 112. The proteins contain a protein domain which is identical or similar to the SEQ ID NO: 87, SEQ ID NO: 88, SEQ ID NO: 89, SEQ ID NO: 90 or SEQ ID NO: 91 domain.

The sequence shown in SEQ ID NO: 114 has been described under its Accession Number At5g02270 as a protein of the ABC transporter family. Homologues of this protein are depicted in SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286 or SEQ ID NO: 288. The proteins contain a protein domain which is identical or similar to the SEQ ID NO: 265, SEQ ID NO: 266, SEQ ID NO:267 or SEQ ID NO: 268 domain.

One embodiment of the invention also relates to an antibody, which binds specifically to the polypeptide according to the invention or parts, i.e. specific fragments or epitopes of such a protein.

The antibodies of the invention can be used to identify and isolate the polypeptide according to the invention and encoding genes in any organism, preferably plants, pre-pared in plants described herein. Such antibodies can also be expressed in the suitable host organisms thereby reducing the biological activity of the genes of the invention by binding to their protein products leading for example to a steric interference with their biological activity. These antibodies can be monoclonal antibodies, polyclonal antibodies or synthetic antibodies as well as fragments of antibodies, such as Fab, Fv or scFv fragments etc. Monoclonal antibodies can be prepared, for example, by the techniques as originally described in Köhler and Milstein, Nature 256 (1975), 495, and Galfré, Meth. Enzymol. 73 (1981), 3, which comprise the fusion of mouse myeloma cells to spleen cells derived from immunized mammals.

Furthermore, antibodies or fragments thereof to the aforementioned peptides can be obtained by using methods, which are described, e.g., in Harlow and Lane "Antibodies, A Laboratory Manual", CSH Press, Cold Spring Harbor, 1988. These antibodies can be used, for example, for the immunoprecipitation and immunolocalization of proteins according to the invention as well as for the monitoring of the synthesis of such proteins, for example, in recombinant organisms, and for the identification of compounds interacting with the protein according to the invention. For example, surface plasmon resonance as employed in the BIAcore system can be used to increase the efficiency of phage antibodies selections, yielding a high increment of affinity from a single library of phage antibodies, which bind to an epitope of the protein of the invention (Schier, Human Antibodies Hybridomas 7 (1996), 97-105; Malmborg, J. Immunol. Methods 183 (1995), 7-13). In many cases, the binding phenomena of antibodies to antigens is equivalent to other ligand/anti-ligand binding.

A further embodiment of the invention also relates to a method for the generation of a transgenic host cell, e.g. a eukaryotic or prokaryotic host or host cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, or the nucleic acid molecule according to the invention.

A further embodiment of the invention also relates to a method for the transient generation of a host or host cell, eukaryotic or prokaryotic cell, preferably a transgenic plant cell or a transgenic plant tissue or a transgenic plant, which comprises introducing, into the plant, the plant cell or the plant tissue, the nucleic acid construct according to the invention, the vector according to the invention, the nucleic acid molecule characterized herein as being contained in the nucleic acid construct of the invention or the nucleic acid molecule according to the invention, whereby the introduced nucleic acid molecules, nucleic acid construct and/or vector is not integrated into the genome of the host or host cell. Therefore the transformants are not stable during the propagation of the host in respect of the introduced nucleic acid molecules, nucleic acid construct and/or vector.

In the process according to the invention, transgenic organisms are also to be understood as meaning—if they take the form of plants—plant cells, plant tissues, plant organs such as root, shoot, stem, seed, flower, tuber or leaf, or intact plants.

Growing is to be understood as meaning for example culturing the transgenic plant cells, plant tissue or plant organs on or in a nutrient medium or the intact plant on or in a substrate, for example in hydroponic culture, potting compost or on a field soil.

In a further advantageous embodiment of the process, the nucleic acid molecules can be expressed in single-celled plant cells (such as algae), see Falciatore et al., 1999, Marine Biotechnology 1 (3): 239-251 and references cited therein, and plant cells from higher plants (for example spermatophytes such as crops). Examples of plant expression vectors encompass those which are described in detail herein or in: Becker, D. [(1992) Plant Mol. Biol. 20:1195-1197] and Bevan, M. W. [(1984), Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, pp. 15-38]. An overview of binary vectors and their use is also found in Hellens, R. [(2000), Trends in Plant Science, Vol. 5 No. 10, 446-451.

Vector DNA can be introduced into prokaryotic or eukaryotic cells via conventional transformation or transfection techniques. The terms "transformation" and "transfection" include conjugation and transduction and, as used in the present context, are intended to encompass a multiplicity of prior-art methods for introducing foreign nucleic acid molecules (for example DNA) into a host cell, including calcium phosphate coprecipitation or calcium chloride coprecipitation, DEAE-dextran-mediated transfection, PEG-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., $2^{nd}$ Ed., Cold Spring Harbor Laboratory, Cold Spring Harbor Laboratory Press, Cold Spring Harbor, N.Y., 1989) and in other laboratory handbooks such as Methods in Molecular Biology, 1995, Vol. 44, *Agrobacterium* protocols, Ed.: Gartland and Davey, Humana Press, Totowa, N.J.

The above-described methods for the transformation and regeneration of plants from plant tissues or plant cells are exploited for transient or stable transformation of plants. Suitable methods are the transformation of protoplasts by polyethylene-glycol-induced DNA uptake, the biolistic method with the gene gun—known as the particle bombardment method—, electroporation, the incubation of dry embryos in DNA-containing solution, microinjection and the *Agrobacterium*-mediated gene transfer. The abovementioned methods are described for example in B. Jenes, Techniques for Gene Transfer, in: Transgenic Plants, Vol. 1, Engineering and Utilization, edited by S. D. Kung and R. Wu, Academic Press (1993) 128-143 and in Potrykus Annu. Rev. Plant Physiol. Plant Molec. Biol. 42 (1991) 205-225. The construct to be expressed is preferably cloned into a vector, which is suitable for transforming *Agrobacterium tumefaciens*, for example pBin19 (Bevan, Nucl. Acids Res. 12 (1984) 8711). *Agrobacteria* transformed with such a vector can then be used in the known manner for the transformation of plants, in particular crop plants, such as, for example, tobacco plants, for example by bathing scarified leaves or leaf segments in an agrobacterial solution and subsequently culturing them in suitable media. The transformation of plants with *Agrobacterium tumefaciens* is described for example by Höfgen and Willmitzer in Nucl. Acid Res. (1988) 16, 9877 or known from, inter alia, F. F. White, Vectors for Gene Transfer in Higher Plants; in Transgenic Plants, Vol. 1, Engineering and Utilization, edited by S. D. Kung and R. Wu, Academic Press, 1993, pp. 15-38.

To select for the successful transfer of the nucleic acid molecule, vector or nucleic acid construct of the invention according to the invention into a host organism, it is advantageous to use marker genes as have already been described above in detail. It is known of the stable or transient integration of nucleic acids into plant cells that only a minority of the cells takes up the foreign DNA and, if desired, integrates it into its genome, depending on the expression vector used and the transfection technique used. To identify and select these integrants, a gene encoding for a selectable marker (as described above, for example resistance to antibiotics) is usually introduced into the host cells together with the gene of interest. Preferred selectable markers in plants comprise those, which confer resistance to an herbicide such as glyphosate or gluphosinate. Other suitable markers are, for example, markers, which encode genes involved in biosynthetic pathways of, for example, sugars or amino acids, such as β-galactosidase, ura3 or ilv2. Markers, which encode genes such as luciferase, gfp or other fluorescence genes, are likewise suitable. These markers and the aforementioned markers can be used in mutants in whom these genes are not functional since, for example, they have been deleted by conventional methods. Furthermore, nucleic acid molecules, which encode a selectable marker, can be introduced into a host cell on the same vector as those, which encode the polypeptides of the invention or used in the process or else in a separate vector. Cells which have been transfected stably with the nucleic acid introduced can be identified for example by selection (for example, cells which have integrated the selectable marker survive whereas the other cells die).

Since the marker genes, as a rule specifically the gene for resistance to antibiotics and herbicides, are no longer required or are undesired in the transgenic host cell once the nucleic acids have been introduced successfully, the process according to the invention for introducing the nucleic acids advantageously employs techniques which enable the removal, or excision, of these marker genes. One such a method is what is known as cotransformation. The cotransformation method employs two vectors simultaneously for the transformation, one vector bearing the nucleic acid according to the invention and a second bearing the marker gene(s). A large proportion of transformants receives or, in the case of plants, comprises (up to 40% of the transformants and above), both vectors. The marker genes can subsequently be removed from the transformed plant by performing crosses. In another method, marker genes integrated into a transposon are used for the transformation together with desired nucleic acid (known as the Ac/Ds technology). In some cases (approx. 10%), the transposon jumps out of the genome of the host cell once transformation has taken place successfully and is lost. In a further number of cases, the transposon jumps to a different location. In these cases, the marker gene must be eliminated by performing crosses. In microbiology, techniques were developed which make possible, or facilitate, the detection of such events. A further advantageous method relies on what are known as recombination systems, whose advantage is that elimination by crossing can be dispensed with. The best-known system of this type is what is known as the Cre/lox system. Cre1 is a recombinase, which removes the sequences located between the loxP sequence. If the marker gene is integrated between the loxP sequence, it is removed, once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

*Agrobacteria* transformed with an expression vector according to the invention may also be used in the manner known per se for the transformation of plants such as experimental plants like *Arabidopsis* or crop plants, such as, for example, cereals, maize, oats, rye, barley, wheat, soya, rice, cotton, sugarbeet, canola, sunflower, flax, hemp, potato, tobacco, tomato, carrot, bell peppers, oilseed rape, tapioca, cassaya, arrow root, tagetes, alfalfa, lettuce and the various tree, nut, and grapevine species, in particular oil-containing crop plants such as soya, peanut, castor-oil plant, sunflower, maize, cotton, flax, oilseed rape, coconut, oil palm, safflower (*Carthamus tinctorius*) or cocoa beans, for example by bathing scarified leaves or leaf segments in an agrobacterial solution and subsequently growing them in suitable media.

In addition to the transformation of somatic cells, which then has to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic (Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289). Alternative methods are based on the repeated removal of the influorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension (Bechthold, N (1993). C R Acad Sci Paris Life Sci, 316: 1194-1199), while in the case of the "floral dip" method the developing floral tissue is incubated briefly with a surfactant-treated agrobacterial suspension (Clough, S J und Bent, A F (1998). The Plant J. 16, 735-743). A certain proportion of transgenic seeds are harvested in both cases, and these seeds can be distinguished from nontransgenic seeds by growing under the above-described selective conditions.

The genetically modified plant cells can be regenerated via all methods with which the skilled worker is familiar. Suitable methods can be found in the abovementioned publications by S. D. Kung and R. Wu, Potrykus or Höfgen and Willmitzer.

Accordingly, the present invention thus also relates to a plant cell comprising the nucleic acid construct according to the invention, the nucleic acid molecule according to the invention or the vector according to the invention.

Accordingly the present invention relates to any cell transgenic for any nucleic acid characterized as part of the invention, e.g. conferring the increase in plant growth in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having biological activity of the protein of the invention. Due to the abovementioned activity the growth in a plant cell or a plant is increased. For example, due to modulation or manipulation, the cellular activity is increased, e.g. due to a decreased expression or decreased specific activity of the subject matters of the invention in a plant cell or a plant or a plant part thereof.

A naturally occurring expression cassette—for example the naturally occurring combination of the promoter of the protein of the invention with the corresponding gene, which codes for the protein of the invention—becomes a transgenic expression cassette when it is modified by non-natural, synthetic "artificial" methods such as, for example, mutagenization. Such methods have been described (U.S. Pat. No. 5,565,350; WO 00/15815; also see above).

Further, the plant cell, plant tissue or plant can also be transformed such that further enzymes and proteins are (over) expressed which expression supports an increase in plant growth. Similarly the plant cell, plant tissue or plant can also be transformed such that further enzymes, transporters or other proteins are inhibited in its expression or activity leading to a further increase in plant growth The term "transgenic plants" used in accordance with the invention refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

In an especially preferred embodiment, the host cell, plant cell, plant or plant tissue according to the invention is transgenic.

Accordingly, the invention therefore relates to transgenic plants transformed with at least one nucleic acid molecule, nucleic acid construct or vector according to the invention, and to plant cells, plant cell cultures, plant tissues, plant parts—such as, for example leaves, roots and the like—or propagation material derived from such plants. The terms "recombinant (host)" and "transgenic (host)" are used interchangeably in this context. Naturally, these terms refer not only to the host organism or target cell in question, but also to the progeny, or potential progeny, of these plants or plant cells. Since certain modifications may occur in subsequent generations owing to mutation or environmental effects, such progeny is not necessarily identical with the parental cell, but still comes within the scope of the term as used herein.

Suitable plants for the process according to the invention or as hosts are e.g. crop plants. The plants used as hosts are plants, such as dicotyledonous or monocotyledonous plants.

In principle all plants can be used as host organism, especially the plants mentioned above as source organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassaya, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Luceme for mentioning only some of them.

Preferred plant cells, plant organs, plant tissues or parts of plants originate from the under source organism mentioned plant families, preferably from the abovementioned plant genus, more preferred from abovementioned plants species.

Transgenic plants produced in the process according to the invention can be marketed directly. In the process according to the invention, plants are understood as meaning all plant parts, plant organs such as leaves, stalk, root, tubers or seeds or propagation material or harvested material or the intact plant. In this context, the seed encompasses all parts of the seed such as the seed coats, epidermal cells, seed cells, endosperm or embryonic tissue.

In yet another aspect, the invention also relates to harvestable parts and to propagation material of the transgenic plants according to the invention which either contain transgenic plant cells expressing a nucleic acid molecule according to the invention or which contains cells which show an reduced, decreased or deleted cellular activity of the polypeptide of the invention, e.g. a decreased expression level or lower activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, seedlings, tubers or fruits as harvestable or propagation material.

The invention furthermore relates to the use of the transgenic plants according to the invention and of the cells, cell cultures, parts—such as, for example, roots, leaves and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

Accordingly in another embodiment, the present invention relates to the use of the nucleic acid molecule in the plants, plant cells or plant tissues, in a vector, or the polypeptide of the present invention for increasing the growth of plants.

Another embodiment of the invention is a double-stranded RNA molecule (dsRNA), whereby the sense strand of said double-stranded RNA nucleic acid molecule has a homology of at least 30%, 35%, 40%, 45%, 50%, 55% or 60%, preferably 65%, 70%, 75% or 80%, more preferably 85%, 90%, 95%, 96%, 97%, 98% or 99% to the nucleic acid molecule of the invention or encoding a protein conferring the expression of a protein having the biological activity of the protein of the invention or comprising a fragment of at least 10 base pairs (=bases, nt, nucleotides), preferably at least 17, 18, 19, 20, 21, 22, 23, 24, 25, 26, 27, 28, 29, 30, 35, 40, 45 or 50, especially preferably at least 40, 50, 60, 70, 80 or 90 base pairs, very especially preferably at least 100, 200, 300 or 400 base pairs, most preferably at least 500, 600, 700, 800, 900 or more base pairs or at least 1000 or 2000 base pairs of a nucleic acid molecule with a homology of at least 50%, 60%, 70%, 80% or 90%, preferably 100% to a nucleic acid molecule conferring the expression of a protein having the biological activity of the protein of the invention or to the nucleic acid molecule of the invention. In another preferred embodiment of the invention the encoded sequence or its part-segment amounts to 17, 18, 19, 20, 21, 22, 23, 24, 25, 26 or 27 bases, preferably to 20, 21, 22, 23, 24 or 25 bases, whereby the homology of the sequence is similar to the aforementioned homologies.

In a preferred embodiment of the invention the sense and antisense strand of the double-stranded RNA are covalently bound or are bound by weak chemical bonds such as hydrogen bonds to each other and the antisense strand is essentially the complement of the sense-RNA strand.

Yet another embodiment of the invention is an antisense nucleic acid molecule, whereby the antisense nucleic acid molecule has a homology of at least 30% to a nucleic acid molecule antisense to a nucleic acid molecule encoding the protein encoded by the nucleic acid molecule of the invention or encoding the protein of the invention and conferring the expression of a protein having the biological activity of a protein of the invention or an antisense nucleic acid molecule comprising a fragment of at least 15, 16, 17, 18, 19, 20, 21, 22, 23, 24, 25, 26, 27, 28, 29, 30, 35, 40, 45 or 50, especially preferably at least 60, 70, 80 or 90 base pairs, very especially preferably at least 100, 200, 300 or 400 base pairs, most preferably at least 500, 600, 700, 800, 900 or more base pairs.

A further embodiment of the invention is a ribozyme, which specifically cleaves a nucleic acid molecule conferring expression of a protein having the biological activity of the protein of the invention or a nucleic acid molecule encoding the protein encoded by the nucleic acid molecule of the invention or the nucleic acid molecule of the invention itself.

A further embodiment of the invention is an antibody, which specifically binds to and therefore inhibits proteins encoded by nucleic acid molecules conferring expression of a protein having the biological activity of the protein of the invention or a nucleic acid molecule encoding the protein encoded by the nucleic acid molecule of the invention or the nucleic acid molecule of the invention itself.

Yet another embodiments of the invention are a viral nucleic acid molecule conferring the decline of a RNA molecule conferring the expression of a protein having the biological activity of the protein of the invention or of a nucleic acid molecule encoding the protein encoded by the nucleic acid molecule of the invention or of the nucleic acid molecule of the invention or a dominant-negative mutant of the protein of the invention or a nucleic acid molecule encoding such a dominant-negative mutant.

In one embodiment, the present invention relates to a method for the identification of a gene product conferring an increase in plant growth in a plant cell or a plant, comprising the following steps:
(a) contacting e.g. hybridising, the nucleic acid molecules of a sample, e.g. plant cells, plant tissues, plants or microorganisms or a nucleic acid library, which can contain a candidate gene encoding a gene product conferring an increase in plant growth after reduction or deletion of its expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in SEQ ID NO: 1 or SEQ ID NO: 113 and, optionally, isolating the full length cDNA clone or complete genomic clone;

(c) reducing or deletion the expressing of the identified nucleic acid molecules in the host cells;

(d) assaying the growth of plant cells or plants or plant parts; and (e) identifying the nucleic acid molecule and its gene product which reduction or deletion of expression confers an increase in growth in the plant cells or plants or plant parts after expression compared to the wild type.

Relaxed hybridisation conditions are: After standard hybridisation procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60° to 68° C. with 0.1% SDS. Further examples can be found in the references listed above for the stringend hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridisation temperature, washing or hybridisation time etc.

In another embodiment, the present invention relates to a method for the identification of a gene product the reduction of which conferring an increased growth of plants, comprising the following steps:

(a) identifying nucleic acid molecules of an organism, which can contain a candidate gene encoding a gene product conferring an increase in plant growth after reduction or deletion of its expression, which are at least 20%, preferably 25%, more preferably 30%, even more preferred are 35%. 40% or 50%, even more preferred are 60%, 70% or 80%, most preferred are 90% or 95% or more homolog to the nucleic acid molecule of the present invention, for example via homology search in a data bank;

(b) reducing or deleting the expression of the identified nucleic acid molecules in the host cells;

(c) assaying the increase in growth of the plant cells or plants or plant parts; and (d) identifying the nucleic acid molecule and its gene product which reduction or deletion of expression confers an increase in plant growth compared to the wild type.

The nucleic acid molecules identified can then be used for the increase in plant growth in the same way as the nucleic acid molecule of the present invention. Accordingly, in one embodiment, the present invention relates to a process for the production of plants with increased growth, comprising (a) identifying a nucleic acid molecule according to aforementioned steps (a) to (d) and harvesting the plants or plant parts transformed according to the invention having an decreased cellular activity of a polypeptide encoded by the isolated nucleic acid molecule compared to a wild type.

Furthermore, in one embodiment, the present invention relates to a method for the identification of a compound stimulating the growth of said plant comprising:

a) contacting cells which express the polypeptide of the present invention or its mRNA with a candidate compound under cell cultivation conditions;

b) assaying a reduction, decrease or deletion in expression of said polypeptide or said mRNA;

c) comparing the expression level to a standard response made in the absence of said candidate compound; whereby, a reduced, decreased or deleted expression over the standard indicates that the compound is stimulating the growth of the plant.

Furthermore, in one embodiment, the present invention relates to a method for the screening for antagonists of the activity of the polypeptide of the present invention, e.g. a polypeptide conferring an increase in plant growth or a part thereof after decreasing the cellular activity, e.g. of the activity of a polypeptide having the biological activity represented by the protein of the invention comprising:

(a) contacting plant cells, plant tissues or plants which express the polypeptide according to the invention with a candidate compound or a sample comprising a plurality of compounds under conditions which permit the expression of the polypeptide of the present invention;

(b) assaying the growth of the plants or plant parts or the polypeptide expression level in the plant cells, tissues or plants; and (c) identifying an antagonist by comparing the measured increase in plant growth or polypeptide expression level with a standard growth rate or polypeptide expression level measured in the absence of said candidate compound or a sample comprising said plurality of compounds, whereby an increased level of plant growth over the standard indicates that the compound or the sample comprising said plurality of compounds is an antagonist.

Yet another embodiment of the invention relates to a process for the identification of a compound conferring increased plant growth comprising the following step:

(a) culturing or maintaining a plant or their tissues expressing the polypeptide of the invention or a polynucleotide encoding said polypeptide and a readout system capable of interacting with the polypeptide under suitable conditions which permit the interaction of the polypeptide with this readout system in the presence of a chemical compound or a sample comprising a plurality of chemical compounds and capable of providing a detectable signal in response to the binding of a chemical compound to said polypeptide under conditions which permit the depression of said readout system and of the protein of the invention; and (b) identifying if the chemical compound is an effective antagonist by detecting the presence or absence or decrease or increase of a signal produced by said readout system.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing the polypeptide of the present invention. The reaction mixture may be a cell free extract or may comprise a cell or tissue culture. Suitable set ups for the method of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the method of the invention, then it is either possible to isolate the compound from the original sample identified as containing the compound capable of activating or increasing the growth of plants or part thereof, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the method of the invention only comprises a limited number of or only one substance(s). Preferably said sample comprises substances of similar chemical and/or physical properties, and most preferably said substances are identical. Preferably, the compound identified according to the described method above or its derivative is further formulated in a form suitable for the application in plant breeding or plant cell and tissue culture.

The compounds which can be tested and identified according to a method of the invention may be expression libraries, e.g., cDNA expression libraries, peptides, proteins, nucleic acids, antibodies, small organic compounds, hormones, peptidomimetics, PNAs or the like (Milner, Nature Medicine 1 (1995), 879-880; Hupp, Cell 83 (1995), 237-245; Gibbs, Cell 79 (1994), 193-198 and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer edition New York Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the method of the invention preferably is a host cell, plant cell or plant tissue of the invention described in the embodiments hereinbefore.

Thus, in a further embodiment the invention relates to a compound obtained or identified according to the method for identifying an antagonist of the invention said compound being an antagonist of the polypeptide of the present invention.

Accordingly, in one embodiment, the present invention further relates to a compound identified by the method for identifying a compound of the present invention.

Said compound is, for example, a homolog of the polypeptide of the present invention. Homologues of the polypeptide of the present invention can be generated by mutagenesis, e.g., discrete point mutation or truncation of the polypeptide of the present invention. As used herein, the term "homologue" refers to a variant form of the protein, which acts as an antagonist of the activity of the polypeptide of the present invention. An antagonist of said protein has lost the biological activities of the polypeptide of the pre-sent invention. In particular, said antagonist confers a decrease of the expression level of the polypeptide of the present invention and thereby the expression of said antagonist in a plant or part thereof confers the increase of growth of the invention in the plant or part thereof.

In one embodiment, the invention relates to an antibody specifically recognizing the compound or antagonist of the present invention.

The invention also relates to a diagnostic composition comprising at least one of the aforementioned nucleic acid molecules, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell. Further methods of detecting the presence of a protein according to the present invention comprise immunotechniques well known in the art, for example enzyme linked immunoabsorbent assay. Furthermore, it is possible to use the nucleic acid molecules according to the invention as molecular markers or primers in plant breeding. Suitable means for detection are well known to a person skilled in the art, e.g. buffers and solutions for hybridization assays, e.g. the aforementioned solutions and buffers, further and means for Southern-, Western-, Northern- etc.-blots, as e.g. described in Sambrook et al. are known.

In another embodiment, the present invention relates to a kit comprising the nucleic acid molecule, the vector, the host cell, the polypeptide, the antisense nucleic acid, the antibody, plant cell, the plant or plant tissue, the harvestable part, the propagation material and/or the compound and/or antagonist identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glass plate, a chip, or a nylon membrane or to the well of a micro titerplate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof or as supplement for the treating of plants, etc.

Further, the kit can comprise instructions for the use of the kit for any of said embodiments, in particular for the use for producing plants or part thereof having an increased growth rate.

In one embodiment said kit comprises further a nucleic acid molecule encoding one or more of the aforementioned protein, and/or an antibody, a vector, a host cell, an antisense nucleic acid, a plant cell or plant tissue or a plant.

In a further embodiment, the present invention relates to a method for the production of a agricultural composition providing the nucleic acid molecule, the vector or the polypeptide of the invention or comprising the steps of the method according to the invention for the identification of said compound or antagonist; and formulating the nucleic acid molecule, the vector or the polypeptide of the invention or the antagonist, or compound identified according to the methods or processes of the present invention or with use of the subject matters of the present invention in a form applicable as plant agricultural composition.

In another embodiment, the present invention relates to a method for the production of plants with increased growth supporting plant culture composition comprising the steps of the method for of the present invention; and formulating the compound identified in a form acceptable as agricultural composition.

Under "acceptable as agricultural composition" is understood, that such a composition is in agreement with the laws regulating the content of fungicides, plant nutrients, herbizides, etc. Preferably such a composition is without any harm for the protected plants and the animals (humans included) fed therewith.

The present invention also pertains to several embodiments relating to further uses and methods. The nucleic acid molecule, polypeptide, protein homologues, fusion proteins, primers, vectors, host cells, described herein can be used in one or more of the following methods: identification of plants useful for the production of plants with increased growth rate as mentioned and related organisms; mapping of genomes; identification and localization of sequences of interest; evolutionary studies; determination of regions required for function; modulation of an activity.

Accordingly, the nucleic acid molecules of the present invention have a variety of uses. First, they may be used to identify a plant or a close relative thereof. Also, they may be used to identify the presence thereof or a relative thereof in a mixed population of plants. By probing the extracted genomic DNA of a culture of a unique or mixed population of plants under stringent conditions with a probe spanning a region of the gene of the present invention which is unique to this, one can ascertain whether the present invention has been used or whether it or a close relative is present.

Further, the nucleic acid molecule of the invention may be sufficiently homologous to the sequences of related species such that these nucleic acid molecules may serve as markers for the construction of a genomic map in related organism or for association mapping. Furthermore natural variation in the genomic regions corresponding to nucleic acids of the invention or homologous thereof may lead to variation in the activity of the proteins of the invention and their homolgous and in consequence in natural variation in the increase of the growth rate. In consequence natural variation eventually also exists in form of less active allelic variants leading already to a relative increase in the growth rate. Different variants of the nucleic acids of the invention, which correspond to different growth rate increasing capabilities can be identified and used for marker assisted breeding for plants showing increased growth rate.

Accordingly, the present invention relates to a method for breeding plants with increased growth rate, comprising
(a) selecting a first plant variety capable of increased groth rate by reducing, decreasing or deleting the expressing of the polypeptide according to the invention;
(b) associating the ability to increase the growth rate with the expression level or the genomic structure of the genes of the invention;
(c) crossing the first plant variety with a second plant variety, which significantly differs in its ability to increase the growth rate; and
(d) identifying, which of the offspring varieties has got the capacity to increase the growth rate by means of analyzing the expression or genomic structure of the genes of the invention.

The nucleic acid molecules of the invention are also useful for evolutionary and protein structural studies. By comparing the sequences of the invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Accordingly, the nucleic acid molecule of the invention can be used for the identification of other nucleic acids conferring an increase in growth rate after reduction, decrease or deletion of their expression.

Further, the nucleic acid molecule of the invention or a fragment of a gene conferring the expression of the polypeptide of the invention, preferably comprising the nucleic acid molecule of the invention, can be used for marker assisted breeding or association mapping of growth rate related traits.

Accordingly, the nucleic acid of the invention, the polypeptide of the invention, the nucleic acid construct of the invention, the plants, the host cell, the plant tissue, plant cell, or the plant part thereof of the invention, the vector of the invention, the antagonist identified with the method of the invention, the nucleic acid molecule identified with the method of the present invention, can be used for the production of plants with increased growth rate.

These and other embodiments are disclosed and encompassed by the description and examples of the present invention. Further literature concerning any one of the methods, uses and compounds to be employed in accordance with the present invention may be retrieved from public libraries, using for example electronic devices. For example the public database "Medline" may be utilized which is available on the Internet, for example under the website at ncbi.nlm.nih.gov/PubMed/medline.html. Further databases and addresses, such as ncbi.nlm.nih.gov/, infobiogen.fr/, fmi.ch/biology/research-tools.html, tigr.org/, are known to the person skilled in the art and can also be obtained using, e.g., lycos.com. An overview of patent information in biotechnology and a survey of relevant sources of patent information useful for retrospective searching and for current awareness is given in Berks, TIBTECH 12 (1994), 352-364.

The present invention is illustrated by the examples, which follow. The present examples illustrate the basic invention without being intended as limiting the subject of the invention. The content of all of the references, patent applications, patents and published patent applications cited in the present patent application is herewith incorporated by reference.

EXAMPLE 1

Engineering of *Arabidopsis* Plants

A binary knock out vector was constructed based on the modified pPZP binary vector backbone (comprising the kanamycin-gene for bacterial selection; Hajdukiewicz, P. et al., 1994, Plant Mol. Biol., 25: 989-994) and the selection marker bar-gene (De Block et al., 1987, EMBO J. 6, 2513-2518) driven by the mas2'1' and mas271f promoters (Velten et al., 1984, EMBO J. 3, 2723-2730; Mengiste, Amedeo and Paszkowski, 1997, Plant J., 12, 945-948).

Examples of other usable binary vectors for insertional mutagenesis are pBIN19, pBl101, pBinAR, pSun or pGPTV. An overview over binary vectors and their specific features is given in Hellens et al., 2000, Trends in plant Science, 5:446-451 and in Guerineau F., Mullineaux P., 1993, Plant transformation and expression vectors in plant molecular biology, LABFAX Series, (Croy R. R. D., ed.) pp. 121-127 Bios Scientific Publishers, Oxford.

EXAMPLE 2

Plant Transformation and Analysis

The plasmid was transformed into *Agrobacterium tumefaciens* (GV3101 pMP90; Koncz and Schell, 1986 Mol. Gen. Genet. 204:383-396) using heat shock or electroporation protocols. Transformed colonies were grown on YEB medium and selected by respective antibiotics (Rif/Gent/Km) for 2 d at 28° C. These *agrobacteria* cultures were used for the plant transformation.

*Arabidopsis thaliana* of the ecotype C24 were grown and transformed according to standard conditions (Bechtold, N., Ellis, J., Pelletier, G. 1993. In planta *Agrobacterium* mediated gene transfer by infiltration of *Arabidopsis thaliana* plants, C. R. Acad. Sci. Paris 316:1194-1199; Bent, A. F., Clough, J. C., 1998; Floral dip: a simplified method for *Agrobacterium*-mediated transformation of *Arabidopsis thaliana*, PLANT J. 16:735-743).

Transformed plants (F1) were selected by the use of their respective resistance marker. In case of BASTA®-resistance, plantlets were sprayed four times at an interval of 2 to 3 days with 0.02% BASTA® and transformed plants were allowed to set seeds. 50-100 seedlings (F2) were subjected again to marker selection, in case of BASTA-resistance by spaying with 0.1% BASTA® on 4 consecutive days during the plantlet phase. Plants segregating for a single resistance locus (approximately 3:1 resistant seedling to sensitive seedlings) were chosen for further analysis. From these lines three of the resistant seedlings (F2) were again allowed to set seeds and were tested for homozygosis through in-vitro germination of their seeds (F3) on agar medium containing the selection agent (BASTA®, 15 mg/l ammonium glufosinate, Pestanal, Riedel de Haen, Seelze, Germany). Those F2 lines which showed nearly 100% resistant offspring (F3) were considered homozygote and taken for functional analysis. For analysis, the plants were cultivated in a phytotron from Swalöf Weibull (Sweden) under the following conditions. After stratification, the test plants were cultured in a 16 h light 8 h dark rhythm at 20° C., a humidity of 60% and a $CO_2$ concentration of 400 ppm for 22-23 days. The light sources used were Powerstar HQI-T 250 W/D Daylight lamps from Osram, which generate light of a color spectrum similar to that of the sun with a light intensity of 220 $\mu E/m^2/s^{-1}$.

On days 24 after sowing, which correspond to approximately day 17 after germination, in each case approximately 40 individual plants of both the wild type (WT) and the KO lines which by visual expection showed increased growth were studied. The fresh weight of aboveground parts of transgenic lines and wild type (WT) *Arabidopsis* plants was determined immediately thereafter, using a precision balance. The differences between the results for the wild type plants and the heaviest transgenic line were tested for significance by means of an ANOVA for each line. One line KO 10488 with increased seed yield, leaf number and fresh weight could be identified, see table 1a.

TABLE 1a

Increase of biomass of transgenic KO10488 *Arabidopsis* plants in comparison to the MC24 wild type (means +/− standard deviation).
For another line KO14595 a strong increase in seed yield and smaller increases in leaf number and fresh weight could be identified.

|  | Seed Yield | Leaf Number | Fresh weight |
|---|---|---|---|
| MC24 | 149.1 (+/−37.9) | 13.08 (+/−7.9) | 224.5 |
| KO10488 | 189.8 (+/−47.9) | 13.6 (+/−2) | 237.5 |

TABLE 1b

Increase of biomass especially seed yield of transgenic KO14595 *Arabidopsis* plants in comparison to the MC24 wild type (means +/− standard deviation).

|  | Seed Yield | Leaf Number | Fresh weight |
|---|---|---|---|
| MC24 | 392.1 (+/−98.6) | 13.3 (+/−6) | 201.9 |
| KO14595 | 557.1 (+/−105.1) | 13.5 (+/−5) | 208.1 |

EXAMPLE 3

Molecular Analysis of KO Lines 10488 and 14595

Since the lines were preselected for single insertion loci and a homozygous situation of the resistance marker, the disruption (or mutation) of single genes through the integration of the T-DNA were expected to have lead to the increased yield phenotype.

Genomic DNA was purified from approximately 100 mg of leaf tissue from these lines using standard procedures (spin columns from Qiagen, Hilden, Germany). The amplification of the insertion side of the T-DNA KO line 10488 was achieved using an adaptor PCR-method according to Spertini D, Béliveau C. and Bellemare G., 1999, Biotechniques, 27, 308-314 using T-DNA specific primers

```
                                       (SEQ ID NO: 96)
    LB1: 5'-TGA CGC CAT TTC GCC TTT TCA-3'
``` for the first and

```
                                       (SEQ ID NO: 97)
    LB2: 5'-CAG AAA TGG ATA AAT AGC CTT GCT TCC-3'
``` for the second PCR respectively.

For line KO14595 TAIL-PCR (Liu Y-G, Mitsukawa N, Oosumi T and Whittier R F, 1995, Plant J. 8, 457-463 was preformed using the degenerated primer ADP3 (5'-WGTG-NAGWANCANAGA-3', SEQ ID: 253). As primers specific for the T-DNA left border, in the first PCR round primer LB1 (5'-TGA CGC CAT TTC GCC TTT TCA-3' SEQ ID: 262), for the second round primer LB2 (5'-CAG AAA TGG ATA AAT AGC CTT GCT TCC-3' SEQ ID 263) and for the last round primer LB3 (5'-CCA ATA CAT TAC ACT AGC ATC TG-3'; SEQ ID: 264) was used.

Appropriate PCR-products were identified on agarose gels and purified using columns and standard procedures (Qiagen, Hilden, Germany). PCR-products were sequenced with additional T-DNA-specific primers located towards the borders relative to the primers used for amplification. For adaptor PCR products containing left border sequences, primer LBseq (5'-CAA TAC ATT ACA CTA GCA TCT G-3') (SEQ ID NO: 98) was used for sequencing reactions. The resulting sequences were taken for comparison with the available *Arabidopsis* genome sequence from Genbank using the blast algorithm (Altschul et al., 1990. J Mol Biol, 215:403-410).

Details on PCR products used to identify the genomic locus are given in table 2. Indicated are the identified annotated open reading frame in the *Arabidopsis* genome, the estimated size of the obtained PCR product (in base pairs), the T-DNA border (LB: left border, RB: right border) for which the amplification was achieved, the method which resulted in the indicated PCR product (explanation see text above) and the respective restriction enzymes used in adaptor PCR.

The identification of the insertion locus in each case was confirmed by a control PCR, using one of the above mentioned T-DNA-specific primers and a primer deduced from the identified genomic locus, near to the insertion side. The amplification of a PCR-product of the expected size from the insertion line using these two primers proved the disruption of the identified locus by the T-DNA integration.

TABLE 2

Details on PCR products used to identify the down-regulated genomic locus in lines showing increased yield.

| SEQ ID NO | ORF | PCR-Product | Border | Method | Restriction enzyme or deg. primer |
|---|---|---|---|---|---|
| 1 | at5g64410 | 620 bp | LB | Adaptor-PCR | Psp1406I/Bsp119I |
| 113 | at5g02270 | 550 bp | LB | TAIL-PCR | ADP3 |

Column 1 refers to the SEQ ID NO of the gene which has been knocked out, column 2 refers to the genebank accession of the gene, column 3 refers to the approximate length of the amplified PCR product, column 4 refers to the T-DNA border for which the PCR product was amplified, column 5 refers to the PCR method for amplification and column 6 refers to restriction enzyme used in the PCR method (for detailed explanation to columns 5 and 6 see text above)

EXAMPLE 4

Construction of Antisense Constructs for Repression of the Genes of the Invention A fragment of SEQ ID NO: 1 is amplified by PCR. To enable cloning of the PCR product, restriction sites may be added to the primers used for the amplification. Alternatively recombination sites may be added to the primers to enable a recombination reaction. The PCR fragment is either cloned or recombined into a binary vector, preferably under control of a strong constitutive, tissue or developmental specific promoter in a way, that the orientation to the promoter is opposite to the direction of the gene in its original genomic position.

The amplification of the fragment of the SEQ ID NO: 1 was performed using the oligonucleotides that have been deduced from the gene sequence:

```
at5g64410fw2:
                                    (SEQ ID NO: 94)
5'-atattaattaaGGTTCAAACATCATATCTTC-3' at5g64410rev2:
                                    (SEQ ID NO: 95)
5'-ataccatggCGGGTTTTGGGAAGCACCTTGG-3'
```

The Oligonucleotides have been solved in water to give a concentration of 20 µm. The PCR reaction contained 5 µl Herculase buffer (Stratagene), 0.4 µl dNTPs (25 mM each) (Amersham), 0.5 µl Primer a07610fw, 0.5 µl Primer a07610rev, 0.5 µl Herculase (Stratagene), 0.5 µl gDNA and 42.6 µl water. The PCR was performed on MJ-Cycler Tetrad (BioZym) with the following program:

4 min 94° C., followed by 30 cycles of 1 min 94° C., 1 min 50° C., 2 min 72° C. followed by 10 min 72° C. and cooling to 25° C.

The PCR product has been purified using a Kit from Qiagen. The DNA was subsequently digested with NcoI/PacI at 37° C. over night. The fragment was then cloned into the vector 1bxPcUbicolic—see FIG. 1—which has been digested with NcoI/PacI. The resulting construct was named 1bxPcUbianti at5g64410.

For Seq ID NO: 113, ORF at5g02270, die antisense repression was carried out in a similar way using primer SEQ ID NO: 256 and SEQ ID NO: 257 for the amplification of the gene fragment.

```
at5g02270fw2:
                                    (SEQ ID NO: 256)
5' atattaattaaTGGAGCCGCATATGGTTAGG- 3' at5g02270rev2:
                                    (SEQ ID NO: 257)
5'atccatggTCAGTCCGTGTTTCAAACTC- 3'
```

EXAMPLE 5

Construction of RNAi Constructs for Repression of the Genes of the Invention

A fragment of SEQ ID NO: 1 is amplified by PCR. To enable cloning of the PCR product, restriction sites may be added to the primers used for the amplification. Alternatively recombination sites may be added to the primers to enable a recombination reaction. The PCR fragment is either cloned or recombined into a binary vector, preferably under control of a strong constitutive, tissue or developmental specific promoter in a way, that the fragment is introduced twice in the vector as an inverted repeat, the repeats separated by a DNA spacer.

The amplification of the fragment of the SEQ ID NO: 1 was performed using the oligonucleotides that have been deduced from the gene sequence:

```
at5g64410fw3:
                                    (SEQ ID NO: 99)
5'-ataggtaccGGTTCAAACATCATATCTTC-3' at5g64410rev3:
                                    (SEQ ID NO: 100)
5'-atagtcgacCGGGTTTTGGGAAGCACCTTGG-3'
```

The oligonucleotides have been solved in water to give a concentration of 20 µm. The PCR reaction contained 5 µl Herculase buffer (Stratagene), 0.4 µl dNTPs (25 mM each) (Amersham), 0.5 µl Primer a07610fw, 0.5 µl Primer a07610rev, 0.5 µl Herculase (Stratagene), 0.5 µl gDNA and 42.6 µl water. The PCR was performed on MJ-Cycler Tetrad (BioZym) with the following program:

4 min 94° C., followed by 30 cycles of 1 min 94° C., 1 min 50° C., 2 min 72° C. followed by 10 min 72° C. and cooling to 25° C.

The PCR product has been purified using a Kit from Qiagen. The DNA was subsequently digested with Asp718/SalI at 37° C. over night. The fragment was then cloned into the vector 10PcUbispacer—see FIG. 2—which has been digested with Asp718/SalI. The resulting construct was digested with XhoI/BsrGI and the same Asp718/SalI digested PCR fragment was ligated into this vector. Subsequently, the expression cassette giving rise to BASTA resistance was ligated as XbaI fragment into this vector that has been opened with XbaI and dephosphorilized before. The resulting construct was named 1 bxPcUbiri3g07610.

For the RNAi repression of at5g02270, SEQ ID NO: 113 the same procedure as described above was followed using the specific primers:

```
at5g02270fw3:
                                    (SEQ ID NO: 260)
5' ataggtaccTGGAGCCGCATATGGTTAGG- 3' at5g02270rev3:
                                    (SEQ ID NO: 261)
5'atagtcgacTCAGTCCGTGTTTCAAACTC- 3'
``` for the amplication of the gene specific fragment.

EXAMPLE 6

Construction of Cosuppression Constructs for Repression of the Genes of the Invention A fragment of SEQ ID NO: 1 is amplified by PCR. To enable cloning of the PCR product, restriction sites may be added to the primers used for the amplification. Alternatively recombination sites may be added to the primers to enable a recombination reaction. The PCR fragment is either cloned or recombined into a binary vector, preferably under control of a strong constitutive, tissue or developmental specific promoter in a way, that the orientation to the promoter is identical to the direction of the gene in its original genomic position.

The amplification of the fragment of the SEQ ID NO: 1 was performed using the oligonucleotides that have been deduced from the gene sequence:

```
at5g64410w4:
                                    (SEQ ID NO: 101)
5'-ataccatggGGTTCAAACATCATATCTTC-3' at5g64410rev4:
                                    (SEQ ID NO: 102)
5'-atattaattaaCGGGTTTTGGGAAGCACCTTGG-3'
```

The oligonucleotides have been solved in water to give a concentration of 20 μm. The PCR reaction contained 5 μl Herculase buffer (Stratagene), 0.4 μl dNTPs (25 mM each) (Amersham), 0.5 μl Primer a07610fw, 0.5 μl Primer a07610rev, 0.5 μl Herculase (Stratagene), 0.5 μl gDNA and 42.6 μl water. The PCR was performed on MJ-Cycler Tetrad (BioZym) with the following program:

4 min 94° C., followed by 30 cycles of 1 min 94° C., 1 min 50° C., 2 min 72° C. followed by 10 min 72° C. and cooling to 25° C.

The PCR product has been purified using a Kit from Qiagen. The DNA was subsequently digested with NcoI/PacI at 37° C. over night. The fragment was then cloned into the vector 1 bxPcUbicolic—see FIG. 1—which has been digested with NcoI/PacI. The resulting construct was named 1 bxPcUbicos3g07610.

For cosuppression of at5g02270, SEQ ID NO: 113 the same procedure as described above was followed using the specific primers:

```
at5g02270fw4:
                                    (SEQ ID NO: 258)
5' atccatggTGGAGCCGCATATGGTTAGG- 3' at5g02270rev4:
                                    (SEQ ID NO: 259)
5' atattaattaaTCAGTCCGTGTTTCAAACTC- 3'
``` for the amplication of the gene specific fragment.

EXAMPLE 7

Reducing the Expression of the Genes of the Invention by Artificial Transcription Factors The genes of the invention and their homologous ORFs in other species may also be down regulated by introducing a synthetic specific repressor. For this purpose, a gene for a chimeric zinc finger protein, which binds to a specific region in the regulatory or coding region of the gene of interest or its homolog in other species is constructed. The artificial zinc finger protein comprises a specific DNA-binding domain consisting for example of zinc finger and optionally a repression domain like the EAR domain (Hiratsu et al., 2003. Plant J. 34(5), 733-739 Dominant repression of target genes by chimeric repressors that include the EAR motif, a repression domain, in *Arabidopsis*).

Expression of this chimeric repressor for example in plants then results in specific repression of the target gene or of its homologs in other plant species which leads to an increase in yield. The experimental details especially about the design and construction of specific zinc finger domains may be carried out as described or as characterised in WO 01/52620 or Ordiz M I, (Proc. Natl. Acad. Sci. USA, 2002, Vol. 99, Issue 20, 13290) or Guan, (Proc. Natl. Acad. Sci. USA, 2002, Vol. 99, Issue 20, 13296).

EXAMPLE 8

Engineering Ryegrass Plants by Repressing the Nucleic Acid Sequence Homologs of the Invention in Ryegrass Seeds of several different ryegrass varieties can be used as explant sources for transformation, including the commercial variety Gunne available from Svalof Weibull Seed Company or the variety Affinity. Seeds are surface-sterilized sequentially with 1% Tween-20 for 1 minute, 100% bleach for 60 minutes, 3 rinses with 5 minutes each with de-ionized and distilled $H_2O$, and then germinated for 3-4 days on moist, sterile filter paper in the dark. Seedlings are further sterilized for 1 minute with 1% Tween-20, 5 minutes with 75% bleach, and rinsed 3 times with ddH2O, 5 min each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, is maintained in culture for another 4 weeks, and is then transferred to MSO medium in light for 2 weeks. Several pieces of callus (11-17 weeks old) are either strained through a 10 mesh sieve and put onto callus induction medium, or are cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve is collecting the cells. The fraction collected on the sieve is plated and is cultured on solid ryegrass callus induction medium for 1 week in the dark at 25° C. The callus is then transferred to and is cultured on MS medium containing 1% sucrose for 2 weeks.

Transformation can be accomplished with either *Agrobacterium* or with particle bombardment methods. An expression vector is created containing a constitutive plant promoter and the repression construct of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 μl sucrose is added to the filter paper. Gold particles (1.0 μm in size) are coated with plasmid DNA according to method of Sanford et al., 1993 and are delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/l kanamycin. Shoots resistant to the selection agent are appearing and once rooted are transferred to soil.

Samples of the primary transgenic plants (TO) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

EXAMPLE 9

Engineering Soybean Plants by Repressing the Nucleic Acid Sequence Homologs of the Invention in Soybean Soybean can be transformed according to the following modification of the method described in the Texas A&M U.S. Pat. No. 5,164,310. Several commercial soybean varieties are amenable to transformation by this method. The cultivar Jack (available from the Illinois Seed Foundation) is commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Removing the radicle, hypocotyl and one cotyledon from each seedling propagates seven-day seedlings. Then, the epicotyl with one cotyledon is transferred to fresh germination media in petri dishes and incubated at 25° C. under a 16-hr photoperiod (approx. 100 μE-m-2s-1) for three weeks. Axillary nodes (approx. 4 mm in length) are cut from 3 to 4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the repression cassette of the trait gene. Various selection marker genes can be used as described above, including the Arabidopsis gene encoding a mutated acetohydroxy acid synthase (AHAS) enzyme (U.S. Pat. Nos. 5,767,366 and 6,225,105). Similarly, various promoters can be used to regulate the repression cassette to provide constitutive, developmental, tissue or environmental repression of gene transcription as described above. In this example, the 34S promoter (GenBank Accession numbers M59930 and X16673) is used to provide constitutive expression of the repression cassette, for example the antisense, the RNAi or the co-suppression construct.

After the co-cultivation treatment, the explants are washed and transferred to selection media supplemented with 500 mg/l timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and is used as recommended by the manufacturer.

EXAMPLE 10

Engineering Corn Plants by Repressing Nucleic Acid Sequence Homologs of the Invention in Corn Transformation of maize (*Zea Mays* L.) is performed with a modification of the method described by Ishida et al. (1996) Nature Biotech 14745-50). Transformation is geno-type-dependent in corn and only specific genotypes are amenable to transformation and regeneration. The inbred line A188 (University of Minnesota) or hybrids with A188 as a parent are good sources of donor material for transformation (Fromm et al., 1990, Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the repression cassette to provide constitutive, developmental, tissue or environmental repression of gene transcription. In this example, the 34S promoter (GenBank Accession numbers M59930 and X16673) is used to provide constitutive expression of the repression cassette.

Excised embryos are grown on callus induction medium, then maize regeneration medium, containing imidazolinone as a selection agent. The Petri plates are incubated in the light at 25° C. for 2 to 3 weeks, or until shoots develop. The green shoots are transferred from each embryo to maize rooting medium and incubated at 25° C. for 2 to 3 weeks, until roots develop. The rooted shoots are transplanted to soil in the greenhouse. T1 seeds are produced from plants that exhibit tolerance to the imidazolinone herbicides and which are PCR positive for the transgenes.

The T1 generation of single locus insertions of the T-DNA can segregate for the trans-gene in a 3:1 ratio. Those progeny containing one or two copies of the transgene are tolerant to the imidazolinone herbicide. Homozygous T2 plants can exhibit similar phenotypes as the T1 plants. Hybrid plants (F1 progeny) of homozygous transgenic plants and non-transgenic plants can also exhibited increased similar phenotypes.

EXAMPLE 11

Engineering Wheat Plants by Repressing Nucleic Acid Sequence Homologs of the Invention in Wheat Transformation of wheat is performed with the method described by Ishida et al. (1996 Nature Biotech. 14745-50). The cultivar Bobwhite (available from CYMMIT, Mexico) is commonly used in transformation. Immature embryos are co-cultivated with *Agrobacterium tumefaciens* that carry "super binary" vectors, and transgenic plants are recovered through organogenesis. The super binary vector system of Japan Tobacco is described in WO94/00977 and WO95/06722. Vectors are constructed as described. Various selection marker genes can be used including the maize gene encoding a mutated acetohydroxy acid synthase (AHAS) enzyme (U.S. Pat. No. 6,025,541). Similarly, various promoters can be used to regulate the repression cassette to provide constitutive, developmental, tissue or environmental regulation of gene repression. In this example, the 34S promoter (GenBank Accession numbers M59930 and X16673) can be used to provide constitutive expression of the repression cassette.

After incubation with *Agrobacterium*, the embryos are grown on callus induction medium, then regeneration medium, containing imidazolinone as a selection agent. The Petri plates are incubated in the light at 25° C. for 2 to 3 weeks until shoots develop. The green shoots are transferred from each embryo to rooting medium and incubated at 25° C. for 2 to 3 weeks until roots develop. The rooted shoots are transplanted to soil in the greenhouse. T1 seeds are produced from plants that exhibit tolerance to the imidazolinone herbicides and which are PCR positive for the transgenes.

The T1 generation of single locus insertions of the T-DNA can segregate for the trans-gene in a 3:1 ratio. Those progeny containing one or two copies to the transgene are tolerant to the imidazolinone herbicide. Homozygous T2 plants exhibit similar phenotypes.

EXAMPLE 12

Engineering Rapeseed/Canola Plants by Repressing Nucleic Acid Sequence Homologs of the Invention in Rapeseed/Canola Plants Cotyledonary petioles and hypocotyls of 5-6 day-old young seedlings are used as explants for tissue culture and transformed according to Babic et al. (1998, Plant Cell Rep 17: 183-188). The commercial cultivar Westar (Agriculture Canada) is the standard variety used for transformation, but other varieties can also be used.

*Agrobacterium tumefaciens* LBA4404 containing a binary vector are used for canola transformation. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the repression cassette of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the repression cassette to provide constitutive, developmental, tissue or environmental regulation of gene repression. In this example, the 34S promoter (GenBank Accession numbers M59930 and X16673) can be used to provide constitutive expression of the repression cassette.

Canola seeds are surface-sterilized in 70% ethanol for 2 min., and then in 30% Clorox with a drop of Tween-20 for 10 min, followed by three rinses with sterilized distilled water. Seeds are then germinated in vitro 5 days on half strength MS medium without hormones, 1% sucrose, 0.7% Phytagar at 23° C., 16 hours light. The cotyledon petiole explants with the cotyledon attached are excised from the in vitro seedlings, and are inoculated with *Agrobacterium* by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hours light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5 to 10 mm in length, they are cut and transferred to shoot elongation medium (MSBAP-0.5, containing 0.5 mg/l BAP). Shoots of about 2 cm in length are transferred to the rooting medium (MSO) for root induction.

Samples of the primary transgenic plants (T0) are analyzed by PCR to confirm the presence of T-DNA. These results are confirmed by Southern hybridization in which DNA is electrophoresed on a 1% agarose gel and are transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

EXAMPLE 13

Engineering Alfalfa Plants by Repressing Nucleic Acid Sequence Homologs of the Invention in Alfalfa A regenerating clone of alfalfa (*Medicago sativa*) is transformed using the method of McKersie et al., 1999 Plant Physiol 119: 839-847. Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants are cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of

*Agrobacterium tumefaciens*. A plant gene expression cassette consists of at least two genes—a selection marker gene and a plant promoter regulating the transcription of the repression cassette of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the repression cassette that provides constitutive, developmental, tissue or environmental regulation of gene repression. In this example, the 34S promoter (Gen-Bank Accession numbers M59930 and X16673) can be used to provide constitutive expression of the repression cassette.

The explants are cocultivated for 3 d in the dark on SH induction medium containing 288 mg/L Pro, 53 mg/L thioproline, 4.35 gA $K_2SO_4$, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/l sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

EXAMPLE 14

Knock Out of the Genes of the Invention by Homologs Recombination

Identifying mutations in the genes of the invention in random mutagenized populations
a) In Chemically or Radiation Mutated Population
   Production of chemically or radiation mutated populations is a common technique and known to the skilled worker. Methods are described by Koomeef et al. 1982 and the citations therein and by Lightner and Caspar in "Methods in Molecular Biology" Vol 82. These techniques usually induce pointmutations that can be identified in any known gene using methods such as TILLING (Mc-Callum et al., 2000) (Nat. Biotech 18, 455-457); Till et al., (Methods Mol Biol. 2003; 236:205-20) and Till et al., (BMC Plant Biol. 2004 Jul. 28; 4(1); 12).
b) In T-DNA or Transposon Mutated Population by Reserve Genetics
   Reverse genetic strategies to identify insertion mutants in genes of interest have been described for various cases e.g. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (eg T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is disrupted by the insertional mutagen.

EXAMPLES 15

Identification of Additional Homologs from Other Species, which can be Knocked Out in a Similar Fashion in Order to Get Biomass Increase Homolgous genes in other species can be found with techniques, well known to the person skilled in the art. For example homologous genes can be found using low or medium stringency hybridisation of cDNA or genomic libraries. The construction and screening of libraries has extensively been described for example by Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons). Alternatively expression libraries can be screened for homologous genes by antibodies prepared against the original gene of interest.

If sequence information are available or can be produced, homologous genes can be easily identified through standard database searches with known algorithms like blastn, blastp or blastx. More sophisticated bioinformatics programs like the Pedant-Pro Suite from Biomax (Biomax Informatic AG, Matinsried, Germany) supports the identification of homologs by homology searches but also by functional categorisations. Identified homologous can then be knock out in their source organisms in similar manners as described above.

EQUIVALENTS

Those of ordinary skill in the art will recognize, or will be able to ascertain using no more than routine experimentation, many equivalents to the specific embodiments of the invention described herein. Such equivalents are intended to be encompassed by the following claims.

---

SEQUENCE LISTING (288 sequences)

SEQ ID NO: 1 - DNA, 2343 bp, Arabidopsis thaliana
  CDS (78)..(2267)
acataaagattcctagtcttatactctgtctctctctctctctctctttttcacactcacacacaaactaaaccggaatggccaccgccgacgaattctccgacgaagatacatcaccgattgaagaagtccgtttaacggtaacaaacaccgacgatccaacactaccggtttggacattcaggatgtggttcttgggtctaatctcatgttctctcctctctttccttaaccaattcttctcgtaccgaaccgaaccgctcgtaatcactcaaatcacggttcaggtggctacactacctatcggtcatttcttggccaaggtgcttcccaaaacccggtttgggttacccggttgtggatcggcccggttctcgctgaacccgggtccgtttaacatgaaagagcatgttttgatatcgatatttgcgaatgcgggtagtgctttcggatccgggtcggcttatgcggttggtatcatcacaattattaaagctttttatggccggagtatctcttttattgccggctggctcctcatcatcactacacaggtattgggatatggctgggccggtttactgaggaaatatgtggtcgaaccggctcatatgtggtggcctagcactctggttcaagtgtcactgtttagggcattgcatgagaaggacgaccaaaggatgacgagagcaaaattctttgtgatagcattagtctgtagttttggatggtacatagtccctggctatctcttcacaacactcacaagcatctcatgggtttgttgggcatttccaagatcagtcactgctcaacagattggttctggaatgagaggtcttggtcttggagcctttacactagactggaccgcggttgcctctttcttgtttagtccacttatcagccccttcttcgccatcgctaatgttttcatcggttatgttcttttgatctacttcgtcttgcctttagcctattggggatttgattcttataacgctacgaggtttcctatattttcgtcgcatcttttcacatcggttggtaatacatatgatattcctgcgatcgtgaatgataactttgagctcgatttagctaagtatgagcaacaaggaaggattaacttgagcatgttctttgctcttacctatgggcttggtttcgccaccattgcttctacgctcactcatgtagctctcttctatggcaaggaaatttctgagaggtttcgagtttcatacaaaggcaaggaagatatacacactaggttaatgaagagatataaagacataccttcatggtggttttactcaatgttggctgcgacactacttatctctcttgcattatgtgttttcttgaacgatgaggttcaaatgccttggtggggacttgtgttcgcaagcgcgatggctttcgtcttcacactcccgataagcatcataaccgcaacaactaaccaaacaccgggattgaatataataacagagtacgcaatgggactcatttacccgggacgacctatcgcaaacgtatgcttcaaagtctatggatacatgagtatggcacaagcagtctctttcttaaatgacttcaaacttggtcattacatgaagatcccacctagatccatgttcttggttcaattcatcggtacaattcttgccggaacaatcaacataacggtcgcatggtggcagttaaactctatcaaaaacatatgtcaagaggaacttctacctcccaacagtccatggacatgtccgggtgaccgtgttttcttcgatgcatcggtcatttggggattggtcggaccaaaacggatttttggttctcagggaaactatgcggccatgaactggtttttcctcggaggtgcattaggaccagtcatagtgtggtcattgcacaaagcgttcccaaaacgttcttggattccacttgtaaatctccctgttcttctaggagcaaccgcaatgatgccacctgcgaccgcggtgaactacaactcgtggatattggtggggacgatattcaacttgtttgtgttccggtacaggaaaagttggtggcagaggtataactacgttctctcagccgctatggatgccggtgtagctttcatggcggttttgttgtacttctcggtggggatggaggaaaagagtttggactggtggggaacaagaggtgaacattgtgatctagctaaatgtccaaccgctagaggagtaattgttgatggttgtccggttaaataatcttaaaggatccattggtgtgtttcaacaatgtatgatacacaaagtaactaattaagaatttcaaaaaaaaatc

SEQ ID NO: 2 - protein, 729 aa, Arabidopsis thaliana
MATADEFSDEDTSPIEEVRLTVTNTDDPTLPVWTFRMWFLGLISCSLLSFLNQFFSYRTEPLVITQITVQVATLPIGHFLAKVLPKTRFGLPGCGSARFSLNPGPFNMKEHVLISIFANAGSAFGSGSAYAVGIITIIKAFYGRSISFIAGWLLIITTQVLGYGWAGLLRKYVVEPAHMWWPSTLVQVSLFRALHEKDDQRMTRAKFFVIALVCSFGWYIVPGYLFTTLTSISWVCWAFPRSVTAQQIGSGMRGLGLGAFTLDWTAVASFLFSPLISPFFAIANVFIGYVLLIYFVLPLAYWGFDSYNATRFPIFSSHLFTSVGNTYDIPAIVNDNFELDLAKYEQQGRINLSMFFALTYGLGFATIASTLTHVALFYGKEISERFRVSYKGKEDIHTRLMKRYKDIPSWWFYSMLAATLLISLALCVFLNDEVQMPWWGLVFASAMAFVFTLPISIITATTNQTPGLNIITEYAMGLIYPGRPIANVCFKVYGYMSMAQAVSFLNDFKLGHYMKIPPRSMFLVQFIGTILAGTINITVAWWQLNSIKNICQEELLPPNSPWTCPGDRVFFDASVIWGLVGPKRIFGSQGNYAAMNWFFLGGALGPVIVWSLHKAFPKRSWIPLVNLPVLLGATAMMPPATAVNYNSWILVGTIFNLFVFRYRKSWWQRYNYVLSAAMDAGVAFMAVLLYFSVGMEEKSLDWWGTRGEHCDLAKCPTARGVIVDGCPVK

SEQ ID NO: 3 - DNA, 2076 bp, Arabidopsis thaliana
  CDS (1)..(2076)
atggacgcggagaaggctactgataagactaatgtccatctctcctcggaccatgagcgttgtccggtggaggaagtggctcttgttgtgcctgagacggatgatccaagcctaccggtgatgacattcagagcttgccactcaccatctcagccatccctcatgcagatcgctggtttgcccatcggcaagttcatggctcggactcttcccaccacttctcacaaccttcttgggtggagttttagcctcaatcctggtccttttaacatcaaggagcatgtcattatcaccatctttgctaattgtggcgttgcttacggtggtggtgatgcttactctattggggctatcactgttatgaaagcttactataaacagagccttagcttcatctgtggtctcttcatcgtcttgaccactcagattttgggttatggttgggctgggattctaaggaggtaccttgttgatcctgttgacatgtggtggccttcaaatctcgctcaagtttctctcttcagagcgttgcacgagaaggaaaacaagtctaaaggcttgacgaggatgaagttctttctagtagctcttggtgctagctttatttactatgcacttccaggctatctattcccaatcttgactttctcctcatgggtttgttgggcttggccaaacagcatcacggctcagcaggttggttcagggtaccatggccttggggttggagccttcactcttgactgggctggcatctctgcttaccatggtagtccattggtggctccatggtcctctatcctcaacgttggtgttggtttcatcatgtttatatacatcatcgtccctgtttgttactggaagttcaacactttcgatgccagaaagttccccatttcctccaaccagctattcactactagtggccagaagtatgacacaaccaagatcttgacaccgcagtttgatctggatattggtgcttataacaactacgggaaactttacctcagccctcttttcgcactctctatcggatccgggtttgcgagattcactgcaacactaactcatgtggcattgttcaacggcagggacatatggaagcagacttggtctgcagtgaacaccacgaagctggacatccatggaaaattgatgcaaagctacaaaaaagtgcctgagtggtggttttatatattgctggcaggaagtgtagccatgtctctcctaatgtcttttgtgtggaaggagtcagtgcagcttccatggtggggaatgctctttgcttttgcattggccttcattgtcacactccctatcggtgtcattcaagcaactacaaatcagcaaccaggatatgatataatagggcagttcattatcggttatatcctgcctggaaaacccattgcaaacctgattttcaagatttacgggagaatcagcacagtccatgctctctcatttttggcagaccttaagcttggccattacatgaaaatcccaccgccctgcatgtacacggctcagctggtgggcactgtggtagctggtgtggtgaatctgggagtggcctggtggatgttggagagcattcaagacatatgcgacatcgaaggagaccaccctaatagcccctggacttgccccaagtatagagtgacgttcgatgcttcagttatttgggggttgataggaccaagacggctctttggaccaggaggcatgtaccgtaaccttgttgggttcttcctcattggagctgtcctgcctgttccccgtgtgggcgctgagcaagatcttcccaaacaagaagtggatccctctcatcaacattccagttatctcctacggctttgcagggatgcctccagccactccaaccaacattgccagctggttggtcacaggaaccatcttcaactactttgtgttcaattaccacaagagatggtggcagaagtacaattacgtactctctgcagcgctcgatgcagggaccgcgttcatgggggtgctcttgttcttcgccctgcagaatgctggacacgacctcaaatggtggggcactga

SEQ ID NO: 4 - protein, 691 aa, Arabidopsis thaliana
MDAEKATDKTNVHLSSDHERCPVEEVALVVPETDDPSLPVMTFRACHSPSQPSLMQIAGLPIGKFMARTLPTTSHNLLGWSFSLNPGPFNIKEHVIITIFANCGVAYGGGDAYSIGAITVMKAYYKQSLSFICGLFIVLTTQILGYGWAGILRRYLVDPVDMWWPSNLAQVSLFRALHEKENKSKGLTRMKFFLVALGASFIYYALPGYLFPILTFSSWVCWAWPNSITAQQVGSGYHGLGVGAFTLDWAGISAYHGSPLVAPWSSILNVGVGFIMFIYIIVPVCYWKFNTFDARKFPISSNQLFTTSGQKYDTTKILTPQFDLDIGAYNNYGKLYLSPLFALSIGSGFARFTATLTHVALFNGRDIWKQTWSAVNTTKLDIHGKLMQSYKKVPEWWFYILLAGSVAMSLLMSFVWKESVQLPWWGMLFAFALAFIVTLPIGVIQATTNQQPGYDIIGQFIIGYILPGKPIANLIFKIYGRISTVHALSFLADLKLGHYMKIPPPCMYTAQLVGTVVAGVVNLGVAWWMLESIQDICDIEGDHPNSPWTCPKYRVTFDASVIWGLIGPRRLFGPGGMYRNLVGFFLIGAVLPVPRVGAEQDLPKQEVDPSHQHSSYLLRLCRDASSHSNQHCQLVGHRNHLQLLCVQLPQEMVAEVQLRTLCSARCRDRVHGGALVLRPAECWTRPQMVGH

SEQ ID NO: 5 - DNA, 2169 bp, Arabidopsis thaliana
  CDS (1)..(2169)
atggctgcgattgaattacacaagccggagatcaacgccgatgacgacgatgacgaatccccggtggagcaggttcgtctcactgtatcgaaccacgacgatccttctctaccagtgtggacgtttcggatgtggtttttagggcttctctcttgtattctcctctcgtttctcaacactttcttcggatacagaactcagcctctgatgatcactatgatctctgttcaagttgttacgttgcctttagggaagcttatggctagggttttgcctgagaccaagtataagattggttcgtgggagttttcttttaatccgggtccctttaacgtcaaggaacatgtgttgatctctatgtttgctaatgctggtgctggatttggatctggtactgcttacgctgttggtattgttgatatcatcatggctttttataaaaggaagattagtttcttggctagttggattcttgtcatcactactcaggacaatgcaagaatgtcacgaggaaagttctttgtgattgcgtttgtttgtagcttcgcgtggtacatattcccagcttatttgttcttgaccttatcatcaatatcttgggtttgttgggcattcccgaagtctatcacagctcagcagttaggatctggaatgtcaggacttgggattggtgcatttgctcttgattggtctgttatagcttcttaccttggaagccctcttgtgactcctttctttgcaattgtcaatgtccttgttggttacgttttggtcatgtatatggttataccaatatcatattggggcatgaatgtgtatgaagcaaacaagtttccaattttctcctctgatctgtttgataagcaagggcaactttacaatatctccaccattgtcaacaacaagtttgaattggacatggagaattatcaacaacaaggtcgggtttatctcagtacgttctttgctatcagttacgggattggtttcgcagcaatcgtttccacactgactcatgttgctctcttcaatggaaagggaatttggcaacaagtacgagcttcaactaaagctaaaatggacatacacacaaggttgatgaagaagtacaaagacataccaggttggtggttttacagtctgcttgcgatctcattggtgctatctcttgtcctctgcattttcatgaaagacgagatccaaatgccttggtggggactccttctagcatcattcatggcccttacattcactgtaccagtcagcattatcacagctactactaatcagactccaggtctgaacattatcacagaatatctcatgggtgtgttgttaccggggagaccaatagctaacgtctgcttcaaaacttatgggtacataagcatgtcacaagctatatcattccttaacgacttcaagctaggccattacatgaagataccaccaagatcgatgttcttagtccagttcataggaacggtgatagcaggaacagtgaatatatcagtggcatggtacttgctgacatcagtagaaaacatctgccagaaggagttgcttcctccaaacagtccatggacatgtccaagtgacagagttttcttcgacgcatcagtgatttggggattagtaggacccaagagaatctttggtcggctaggaaactaccctgcactaaactggttcttcttaggtggactaataggaccggtcctcgtgtggcttctccaaaaagccttcccaacgaaaacatggatctcgcagatcaatctcccagttcttttaggagcaacagcagcaatgccgccagcgacaagcgtgaacttcaactgctggatcatagtaggagtgatattcaattactttgtgttcaagtactgcaaaaagtggtggcagaggtataactacgtgctatcggcagctttggatgcgggattggcgttcatgggagtgttgttatactttagtttgacgatgaatggaatatcgataaatcattggtggggtgctaagggtgagaattgtcctcttgcttcttgtcctactgctcctggtgttctagttgatgattttacagttttttttttctttttgaagatatttgttccatttgttaacaaaaacagactcaatgattttttatccatgtatctgttatactaa

SEQ ID NO: 6 - protein, 722 aa, Arabidopsis thaliana
MAAIELHKPEINADDDDDESPVEQVRLTVSNHDDPSLPVWTFRMWFLGLLSCILLSFLNTFFGYRTQPLMITMISVQVVTLPLGKLMARVLPETKYKIGSWEFSFNPGPFNVKEHVLISMFANAGAGFGSGTAYAVGIVDIIMAFYKRKISFLASWILVITTQDNARMSRGKFFVIAFVCSFAWYIFPAYLFLTLSSISWVCWAFPKSITAQQLGSGMSGLGIGAFALDWSVIASYLGSPLVTPFFAIVNVLVGYVLVMYMVIPISYWGMNVYEANKFPIFSSDLFDKQGQLYNISTIVNNKFELDMENYQQQGRVYLSTFFAISYGIGFAAIVSTLTHVALFNGKGIWQQVRASTKAKMDIHTRLMKKYKDIPGWWFYSLLAISLVLSLVLCIFMKDEIQMPWWGLLLASFMALTFTVPVSIITATTNQTPGLNIITEYLMGVLLPGRPIANVCFKTYGYISMSQAISFLNDFKLGHYMKIPPRSMFLVQFIGTVIAGTVNISVAWYLLTSVENICQKELLPPNSPWTCPSDRVFFDASVIWGLVGPKRIFGRLGNYPALNWFFLGGLIGPVLVWLLQKAFPTKTWISQINLPVLLGATAAMPPATSVNFNCWIIVGVIFNYFVFKYCKKWWQRYNYVLSAALDAGLAFMGVLLYFSLTMNGISINHWWGAKGENCPLASCPTAPGVLVDDFTVFFFFLKIFVPFVNKNRLNDFLSMYLLY

SEQ ID NO: 7 - DNA, 2400 bp, Saccharomyces cerevisiae
  CDS (1)..(2400)
atgagtaccatttatagggagagcgactcgttggagtcggagccctcgccaacgccaacaaccattcctatccagatcaatatggaagaggaaaagaaagatgctttcgttaagaatattgacgaggacgtcaataatctcactgcgactactgatgaggaggaccgcgatccggaaagccaaaaattcgacaggcattccatacaggaggaaggtctcgtttggaagggcgaccctacatacttgcccaattctccatatcctgaagtgagatcggcggtgtccatcgaggatgaccccaccatccgcctcaaccactggagaacgtggttcttgaccacggtgtttgtggtagttttcgccggtgttaatcaatttttttccctgagatatccatcgctagagatcaacttccttgttgcacaagttgtttgctacccaattggtaggatactggctctcttgcccgactggaagtgttctaaagtgccatttttcgatttaaacccgggcccatttaccaaaaaggaacacgccgtggtcacaattgccgtggcgcttacttcctctactgcatacgctatgtacattttgaacgcccagggaagcttttacaacatgaaacttaatgtcggatatcagttcttgttggtttggacatctcaaatgattggttatggtgctgcaggtcttaccagaagatgggtcgtcaaccctgcaagctctatctggcctcagactttaatttcagtgtccttgtttgattcgttgcactcgagaaaagttgaaaagacagtcgcaaatggttggacgatgccccgttacaggttcttcttaatcgtccttatcggatcgttcatctggtattgggtacctggattcctctttaccggtctgtcctatttcaacgttatcctatgggggtcgaagacaagacacaatttcatcgctaacacaatctttggtactcaaagtggtctcggtgcgttgccaattacatttgactacacccaggtttcccaagccatgtccggctctgttttcgccacaccattctacgtctccgccaacacctatgcatcagtgttgatattcttcgtcatagtgctgccatgtctttattttacgaatacctggtatgccaaatacatgcccgtcatttcaggttctacttatgacaacactcaaaacaaatacaacgtaacaaagattcttaacgaggattattccattaatcttgagaaatataaggaatactcaccggtattcgttccattttcctatcttttgtcgtatgctttaaattttgccgctgttatcgccgtttttgtccactgcatcttataccacggtaaagatattgtcgccaagtttaaagaccgtaaaaatggtggcactgacattcacatgagaatctactccaagaactataaggattgtcccgattggtggtatttacttttgcagattgtcatgatcggtttaggatttgtagcagtgtgctgtttcgatactaagttcccagcttgggcatttgttattgcaatattaatttcccttgtaaatttcatcccgcaaggtatcttggaagcaatgactaaccaacacgtaggtttgaatattatcacagaattgatctgcggttatatgctgcctttaagaccaatggcaaacttattattcaagctatacggatttattgtcatgagacaaggcttgaatttgagtagagatttgaaattagccatgtacatgaaggtttcccctcgtttgatctttgccgttcaaatctatgccactatcatatcaggcatggttaacgttggtgtccaggaatggatgatgcataatatcgatggcttatgtaccaccgatcaaccaaatggcttcacttgtgctaatggtcgcacggttttcaatgcttccattatctggtctttgccaaagtatcttttctcatcagggcgcatttataatccgctgatgtggttcttcttgattggtttgctattcccactagccgtttatgctgttcaatggaaattccctaaatttaaatttgctaagcacattcatactcctgtatttttcacaggcccaggtaatattccaccaagcacaccttataactactcattattttttgcaatgtcattctgcctaaacttgataagaaaaagatggagagcttggttcaataagtacaatttcgtcatgggggccggtgttgaagcaggtgtggcaatctccgtcgtcatcatcttcttgtgtgtacagtacccaggtggtaagctcagctggtggggaaacaacgtttggaaaagaacgtatgataatgattataaaaaattttataccttaaagaaaggtgagacatttggttatgataaatggtggtaa

SEQ ID NO: 8 - protein, 799 aa, Saccharomyces cerevisiae
MSTIYRESDSLESEPSPTPTTIPIQINMEEEKKDAFVKNIDEDVNNLTATTDEEDRDPESQKFDRHSIQEEGLVWKGDPTYLPNSPYPEVRSAVSIEDDPTIRLNHWRTWFLTTVFVVVFAGVNQFFSLRYPSLEINFLVAQVVCYPIGRILALLPDWKCSKVPFFDLNPGPFTKKEHAVVTIAVALTSSTAYAMYILNAQGSFYNMKLNVGYQFLLVWTSQMIGYGAAGLTRRWVVNPASSIWPQTLISVSLFDSLHSRKVEKTVANGWTMPRYRFFLIVLIGSFIWYWVPGFLFTGLSYFNVILWGSKTRHNFIANTIFGTQSGLGALPITFDYTQVSQAMSGSVFATPFYVSANTYASVLIFFVIVLPCLYFTNTWYAKYMPVISGSTYDNTQNKYNVTKILNEDYSINLEKYKEYSPVFVPFSYLLSYALNFAAVIAVFVHCILYHGKDIVAKFKDRKNGGTDIHMRIYSKNYKDCPDWWYLLLQIVMIGLGFVAVCCFDTKFPAWAFVIAILISLVNFIPQGILEAMTNQHVGLNIITELICGYMLPLRPMANLLFKLYGFIVMRQGLNLSRDLKLAMYMKVSPRLIFAVQIYATIISGMVNVGVQEWMMHNIDGLCTTDQPNGFTCANGRTVFNASIIWSLPKYLFSSGRIYNPLMWFFLIGLLFPLAVYAVQWKFPKFKFAKHIHTPVFFTGPGNIPPSTPYNYSLFFAMSFCLNLIRKRWRAWFNKYNFVMGAGVEAGVAISVVIIFLCVQYPGGKLSWWGNNVWKRTYDNDYKKFYTLKKGETFGYDKWW

SEQ ID NO: 9 - DNA, 2634 bp, Saccharomyces cerevisiae
  CDS (1)..(2634)
atgagtgaaacagtcaaagataaagttataattgatgagaaggtatccacaaaaggtactgttgattacgccgagggtgctgagtattctgagaggctttcaaatcattcatcagacttttctcagtggtatacggatgaacagatactgcactttatgaagaagctgggttatgaaaatcgcactctttatgatattccggaagacgttgcgtatatcctcaaaaaaatgcctgaattgacacttgaggattccttcaaaatactaaaagactctatcatctatttcaaggatgatgagaacattccacacgatcaatatgaggagtggaagagattggttgacttggaggacttggattcaaaagaggggatagatgaatatgatagctttgacattagagcatttgcttctgctattaaatttcattcgccttaccaagaggttagagctgttgttgatccagaagatgatcccaccattccagtggagacattccgagcatattttctggcaataatttggtctgtcatcggttcaggatttaatgagtttttttcacacagggtggtttcaatttcactgaatactccaattatccaaatgtttttatatatctgtggtaaggcttgggctaaaactatcccctgttggactataaccatcaggggcagaaagtatggtatcaatatcgataaaccatggacccaaaaagagcaaatgttttcaaccttgttatatgcaatttgtcaaggcgcgttctatactcattacaatattctaacgcaaaaactcttttaccattctgctttctcgtttggctaccaatttttactttcgttatccgtacaatttattggatttggatttgctggcatccttagaaaattcgttgtttatccagcccgtgcactatggccaacagtcatgccaactattgctatcaacaaggcactattgggtaaagaaaagcatgaatctggaatgagcaggtataaattctttttcttgactttttttatcatgttcatctataactggtttcccacttacattattaatattctaaacactttcaattggatgacctggatcaagccaagtaacattaatctcgcaaacatcacgggaggagtcactggtcttgggattaatcctatctcatcttttgactggaatgttatttcgtttaattctcctttagtttacccattttggtcatacttaacacaatatcttggttgcatattagcagctttaattgttattgcagtatactatagtaattatatgagttgccaatacctgccaatattcacaaattctttgtatactaatactggccattcctttaaagttactgaggtattagacagtgacaataagctagatgtgaaaaaatatcaaagctactcgccaccatactatagtgctggaaatttggtatcatatggtgctttcatttgcgcatatcctctgatgattacatggtcgtttattgtacactcaaagttattgttcaatgctttcaaagattgggctttgaatttgtgggccatgagaaaacttaaatcttgggtcacaatgttcaaaagcgattacagggcgctcgacgattatgatgacccacattctaatgccatgaaaaactataaagaagttccagattggtggtattttgccatattgataggttcacttgttgttggaatagctgttgtagagcactacccaacaaatacaccagtttggggtctttttgtttgtttaggatttaattttgttttcttgattccaactactatccttcaagcaaccactggttattcgtttggtttgaatctactaattgaaatggtgatggggtacgctttaccaggtaatccaatcgccataatgattttgaaggcttttggttataacatcgacggccaagcagataattacgtttctaacttaaaaatagcgcattattgtaagattccgccaatggcgctattcaggggacaatgtgttatagttttcattcagatatttgtcaatctaggtgttctgaattggcaaatctccaatatcaaagacttttgcacacctcatcaaaacgcaaaattcacctgtcctgatgctgtgacctactataatgcttccgttgtctggggtgcaattgggccaaaaagaattttcaattacatttatccaatatttaaatggtgttggttgataggcgcatgcattggcatattttttggtgtttggaagcgctggggtaagttttatcccagatattttgacccaatgttatttgtaggtggaatgcttaatatgagccctccatataacctgatgtattacacttctggtatgattgttagttacatttcccagtactacatgaaaagacaccatttaaatctgtgggagaaatataattatgttttatcggcaggcttttcaacgggcttggttttatcagctattatcattttctttgctgtccaatataaagacacagcttttaattggtggggcaatacagttccgtatgctggtgccgatggcgttggctatcctctaaagaacataactgatacagcaaatggctatttcggctatgctccaggacactatccatga

SEQ ID NO: 10 - protein, 877 aa, Saccharomyces cerevisiae
MSETVKDKVIIDEKVSTKGTVDYAEGAEYSERLSNHSSDFSQWYTDEQILHFMKKLGYENRTLYDIPEDVAYILKKMPELTLEDSFKILKDSIIYFKDDENIPHDQYEEWKRLVDLEDLDSKEGIDEYDSFDIRAFASAIKFHSPYQEVRAVVDPEDDPTIPVETFRAYFLAIIWSVIGSGFNEFFSHRVVSISLNTPIIQMFLYICGKAWAKTIPCWTITIRGRKYGINIDKPWTQKEQMFSTLLYAICQGAFYTHYNILTQKLFYHSAFSFGYQFLLSLSVQFIGFGFAGILRKFVVYPARALWPTVMPTIAINKALLGKEKHESGMSRYKFFFLTFFIMFIYNWFPTYIINILNTFNWMTWIKPSNINLANITGGVTGLGINPISSFDWNVISFNSPLVYPFWSYLTQYLGCILAALIVIAVYYSNYMSCQYLPIFTNSLYTNTGHSFKVTEVLDSDNKLDVKKYQSYSPPYYSAGNLVSYGAFICAYPLMITWSFIVHSKLLFNAFKDWALNLWAMRKLKSWVTMFKSDYRALDDYDDPHSNAMKNYKEVPDWWYFAILIGSLVVGIAVVEHYPTNTPVWGLFVCLGFNFVFLIPTTILQATTGYSFGLNLLIEMVMGYALPGNPIAIMILKAFGYNIDGQADNYVSNLKIAHYCKIPPMALFRGQCVIVFIQIFVNLGVLNWQISNIKDFCTPHQNAKFTCPDAVTYYNASVVWGAIGPKRIFNYIYPIFKWCWLIGACIGIFFGVWKRWGKFYPRYFDPMLFVGGMLNMSPPYNLMYYTSGMIVSYISQYYMKRHHLNLWEKYNYVLSAGFSTGLVLSAIIIFFAVQYKDTAFNWWGNTVPYAGADGVGYPLKNITDTANGYFGYAPGHYP

SEQ ID NO: 11 - DNA, 2301 bp, Arabidopsis thaliana
  CDS (1)..(2301)
atggaagaatcagaacaagttcttcctctattaacaaacccaaaagatctgacaaacccatcatatgcgtcatcatcttcatcttcatctgaaccaagagatgaaacagaggatcttcttttaccaatctccgacgagaatgaggaggaagaagaagagaactcaccaatccgacaagtagcactcactgttccgacaacagatgatccttcattacctgtcttaacatttcgcatgtgggtcttaggaactctctcttgcatcctcttgtcgtttctcaatcagttcttctggtatagaacagaacctctcactatctctgccatctccgctcaaatcgccgtcgtaccacttggtcgtctcatggctgctaaaatcaccgatagagtcttcttccaaggatcaaagtggcagtttacgttgaatccaggtccgtttaatgtgaaagagcatgtgttgatcactattttcgctaacgcgggagctggatctgtttacgcaatacacgttgttaccgtggtcaaagcgttttacatgaagaacataacgttctttgtgtctttcatcgttatcgttaccacccaagtgttaggttttggatgggctggaatatttaggaaataccttgttgaaccggcggcgatgtggtggccggcgaatcttgttcaagtctcactatttagagctttgcacgagaaagaagaacggaccaaaggagggctgacacgtacacaattcttcgtgatagcattcgtttgcagtttcgcttattatgtctttccgggctacttatttcagatcatgacgtcgttgtcgtgggtttgttggttctttccatcatcagttatggcccaacagatcgggtctggtcttcacgggttaggtgttggggccataggacttgactggtcaaccatttcctcttacttgggtagtccactcgctagtccatggtttgctacggctaatgtgggtgtgggatttgtgctggtgatatatgtcttggtaccaatatgctattggctcgatgtgtacaaggccaagaccttccccatattttcgagctcacttttttcgagccagggttcaaagtacaacatcacatccattatagactctaatttccaccttgacctcccagcctacgagcgtcaaggccctttgtatctttgcactttcttcgccattagttacggtgttggttttgccgctttaagcgctaccatcatgcatgttgctctcttccacggaagggagatatgggagcagagtaaggagagttttaaagaaaagaaattggatgtacacgcgaggctaatgcaaaggtacaaacaagttccagagtggtggttttggtgcatactcgttaccaacgttggagccacaatctttgcttgtgagtattacaatgaccaacttcaattaccatggtggggtgttctattggcatgtaccgtcgccattatctttacacttcctatcggtatcatcaccgccatcaccaatcaggcgccaggattgaacattattacagaatatatcataggatatatctatccaggatatccagttgcaaatatgtgctttaaagtatatggatacataagcatgcaacaagccatcacgtttcttcaagactttaagcttggtcactacatgaagataccacctagaaccatgttcatggcacagattgttggaacactcatctcatgttttgtttacctcacaacggcttggtggctaatggagaccatccccaacatatgtgattcggttactaactcggtttggacatgtccatcggataaagtcttttatgatgcatcggtgatatggggacttattggacctcgtagaatctttggagatcttggtttatacaaatccgttaattggttcttccttgtgggcgctatagcccctattcttgtatggttagcttcaaggatgtttcctagacaagagtggatcaagcttataaacatgccggttcttataagcgcgacaagctcgatgccgcccgcaacagccgtgaactacacaacatgggttcttgctggattcttatccggatttgttgtgtttaggtacaggccaaatctatggcagaggtataattatgttttgtcaggagcattggatgctggattagcatttatgggtgtgttgctttatatgtgtttgggacttgagaatgtgagtttggattggtggggaaatgagcttgatggttgtcctttggcctcttgtccaaccgcgcctggtattattgttgaaggatgcccgctttatacgtaa

SEQ ID NO: 12 - protein, 766 aa, Arabidopsis thaliana
MEESEQVLPLLTNPKDLTNPSYASSSSSSSEPRDETEDLLLPISDENEEEEEENSPIRQVALTVPTTDDPSLPVLTFRMWVLGTLSCILLSFLNQFFWYRTEPLTISAISAQIAVVPLGRLMAAKITDRVFFQGSKWQFTLNPGPFNVKEHVLITIFANAGAGSVYAIHVVTVVKAFYMKNITFFVSFIVIVTTQVLGFGWAGIFRKYLVEPAAMWWPANLVQVSLFRALHEKEERTKGGLTRTQFFVIAFVCSFAYYVFPGYLFQIMTSLSWVCWFFPSSVMAQQIGSGLHGLGVGAIGLDWSTISSYLGSPLASPWFATANVGVGFVLVIYVLVPICYWLDVYKAKTFPIFSSSLFSSQGSKYNITSIIDSNFHLDLPAYERQGPLYLCTFFAISYGVGFAALSATIMHVALFHGREIWEQSKESFKEKKLDVHARLMQRYKQVPEWWFWCILVTNVGATIFACEYYNDQLQLPWWGVLLACTVAIIFTLPIGIITAITNQAPGLNIITEYIIGYIYPGYPVANMCFKVYGYISMQQAITFLQDFKLGHYMKIPPRTMFMAQIVGTLISCFVYLTTAWWLMETIPNICDSVTNSVWTCPSDKVFYDASVIWGLIGPRRIFGDLGLYKSVNWFFLVGAIAPILVWLASRMFPRQEWIKLINMPVLISATSSMPPATAVNYTTWVLAGFLSGFVVFRYRPNLWQRYNYVLSGALDAGLAFMGVLLYMCLGLENVSLDWWGNELDGCPLASCPTAPGIIVEGCPLYT

SEQ ID NO: 13 - DNA, 2355 bp, Arabidopsis thaliana
  CDS (5)..(2215)
aacgatgggagagatagcaacagagttcacgccggttatggatgatgatgatgaccggtgcgttgtaccggaggtagagctcactgtacccaagaccgacgattcaactttaccggttttaacatttcggatgtgggttcttggtataggcgcgtgcattgtactctcctttatcaaccagtttttctggtacagaacgatgccgttgagtatcaccggaatctccgctcagatcgccgtcgtgccgcttggtcatctcatggcgagagtgcttccgacaaaaagattcttggaaggtacgaggtttcagtttaccttaaacccgggtgccttcaacgtcaaggaacatgttctgataactatctttgcaaattccggcgccggctctgtttacgctactcacatacttagtgctattaagctttactacaaacgttctcttcctttcctccctgcatttctcgtcatgatcaccactcagattcttggatttggttgggctggtctcttcaggaaacaccttgttgagcctggtgaaatgtggtggccaagcaatcttgttcaagtctctctctttggtgcgttacacgagaaagaaaagaaatcaagaggaggcatgagtagaactcaattcttcttaatcgtcctcgtagctagctttgcttactacatctttcctggttatcttttcaccatgttaacatcaatctcatgggtctgttggctcaatcccaaatcaattctggtaaaccaactcggttcaggtgaacatggtcttggcattggttccattggttttgattgggtcactattagtgcttatcttggaagccctttagctagtcctttgttcgcttccgtcaatgtagccattggtttcgtgctggttatgtatatcgtcacgcctgtttgttactggcttaacatttatgatgccaagaccttccctatcttctctagtcagctcttcatggggaatggctcacgttatgatgttttgagcattattgatagcaaattccatcttgaccgtgtggtttactctaggaccgggtccatcaatatgagcaccttctttgctgttacttatggtctcgggtttgctacattgtctgccaccattgtccatgttttagtcttcaacggaagtgacttgtggaagcagacaagaggggcgtttcagaagaataagaaaatggatatacacacgagaatcatgaagaaaaactacagggaagttccattgtggtggtttttggtaatccttttactgaatatcgcgcttatcatgttcatctccgtgcactacaacgctactgtgcagcttccttggtggggagtgttacttgcttgtgccattgccatcagtttcactcctttgatcggtgtcatagctgccaccactaatcaggcaccgggattgaatatcataacagagtatgttatcgggtatatctacccggaacgtcctgttgcaaacatgtgtttcaaggtctatggatacattagtatgactcaagcgctaactttcatttccgacttcaagcttggtcattacatgaagatcccgcctagatccatgttcatggctcaggtggctgggacacttgtggcggtggttgtgtacacaggaacagcctggtggttaatggaagagattcctcatctttgtgatacatccttgcttccttcagacagccaatggacttgtcccatggaccgcgttttctttgacgcctctgtgatttggggactagtgggaccacgcagggtgtttggagaccttggagaatactcaaatgtcaactggttcttcctcgttggagccatagctccactcttagtttggctagccacaaagatgtttccggctcagacatggatcgccaagattcatatccctgtccttgtgggagccaccgcaatgatgccaccagcaacagcagttaacttcactagttggctcatcgtcgcattcatctttggccacttcatcttcaagtacagaagagtgtggtggaccaagtataactatgtgttgtctggtggtttagatgctggctctgcttttatgaccatacttctgtttctagcactcggacgaaaaggaattgaagtgcagtggtggggaaattccggcgaccgagatacatgtcccttagcttcttgtccaactgctaaaggtgttgtcgtcaaaggctgtcccgtcttctagctcatgagtcatgagacaaaagcatataccaagtgctttgtacagaacacacagcaaactgataattgtaattctcggaaatgtctttactctccaagaactatatcttttgtgatagctttaaaactaggtactatcct

SEQ ID NO: 14 - protein, 736 aa, Arabidopsis thaliana
MGEIATEFTPVMDDDDDRCVVPEVELTVPKTDDSTLPVLTFRMWVLGIGACIVLSFINQFFWYRTMPLSITGISAQIAVVPLGHLMARVLPTKRFLEGTRFQFTLNPGAFNVKEHVLITIFANSGAGSVYATHILSAIKLYYKRSLPFLPAFLVMITTQILGFGWAGLFRKHLVEPGEMWWPSNLVQVSLFGALHEKEKKSRGGMSRTQFFLIVLVASFAYYIFPGYLFTMLTSISWVCWLNPKSILVNQLGSGEHGLGIGSIGFDWVTISAYLGSPLASPLFASVNVAIGFVLVMYIVTPVCYWLNIYDAKTFPIFSSQLFMGNGSRYDVLSIIDSKFHLDRVVYSRTGSINMSTFFAVTYGLGFATLSATIVHVLVFNGSDLWKQTRGAFQKNKKMDIHTRIMKKNYREVPLWWFLVILLLNIALIMFISVHYNATVQLPWWGVLLACAIAISFTPLIGVIAATTNQAPGLNIITEYVIGYIYPERPVANMCFKVYGYISMTQALTFISDFKLGHYMKIPPRSMFMAQVAGTLVAVVVYTGTAWWLMEEIPHLCDTSLLPSDSQWTCPMDRVFFDASVIWGLVGPRRVFGDLGEYSNVNWFFLVGAIAPLLVWLATKMFPAQTWIAKIHIPVLVGATAMMPPATAVNFTSWLIVAFIFGHFIFKYRRVWWTKYNYVLSGGLDAGSAFMTILLFLALGRKGIEVQWWGNSGDRDTCPLASCPTAKGVVVKGCPVF

SEQ ID NO: 15 - DNA, 2628 bp, Arabidopsis thaliana
  CDS (206)..(2467)
aatactagtacatcctctcaaacatcttaactaaaacagaggtctaactttttcctttttcctggaaaaattgcagagaaaatttatttttaatgtcaggtcattaacacaggttgcttacaagaacattacttctacagcaagttattcagaactctggacattatcacccgagtcgatcgacgtcagggccgcctaacagaaaatggtaggctctctcgaagtatccaagcctccagagcacaaggttgagtccaagatcgtcatagccgatgaagaagaagaggatgaaaacgacagtccaatcgaagaggtccgtttaaccgtaccgataaccgacgatccatctctaccagttttgacattccgtacatggttcttaggaatggtttcttgcgtggtactcgcgttcgtgaacaatttcttcggttaccggtcgaacccgctcacggtatcttcagtcgtggctcagatcatcactctccctctaggaaagctcatggccacgactctaccaacaacaaaactccgtttacctggtacaaattggtcgtgttcgttgaaccctggaccattcaacatgaaggaacatgtactgatcactatattcgctaataccggagctggaggagcttatgccaccagcatcctaaccatcgttaaagcattttatcaccggaatctcaatcccgccgccgccatgttgcttgtccaaaccactcagttgttgggatatggatgggcgggtatgttcaggaaatacctagtggactcaccttacatgtggtggcctgcaaatcttgttcaagtctctctctttagagccttacatgagaaggaggagaagcgtgaaggaaaacaaacgaaacttagattcttcttgatagtcttcttcctgagcttcacttactacatagtcccaggctatcttttcccttccatctcatatctctcctttgtctgctggatatggacccgctctgtaaccgctcaacagatcggttcagggctgcacggtctcggcattggctcatttggtcttgattggtccacggttgcaggtttcttaggcagtcctttagctgtaccgttcttcgctatagccaattcctttggcggatttatcatcttcttctacatcatccttcctatcttctactggagcaacgcttacgaggcaaagaagtttcctttctatacctctcacccatttgatcacactggtcagcgttacaacaccactcgtatcctcaaccagaaaacattcaatattgatcttcctgcttacgaaagctatagcaagctttaccttagcattctgtttgctctgatctatgggctcagcttcggtacccttaccgcaaccatttctcatgtcgccctctttgacggaaagtttatctgggagctgtggaagaaggcaacattgacgacaaaggacaagtttggagatgtgcatacaagattgatgaagaagaattataaggaagtacctcaatggtggttcgttgcggttctcgctgcttcctttgtgctagctctttatgcatgtgagggatttggcaaacagcttcagctcccatggtggggacttttactcgcttgtgccatcgcctttaccttcactttgcctattggagttatcctagcgaccacaaaccagcgaatgggtcttaatgttatatcggaactgatcatcgggttcttgtatccgggaaagccacttgccaatgtggcttttaagacttatggttctgtgagtatagctcaagccttgtactttgtcggagacttcaaacttggccactacatgaagattcctccgagatctatgttcatcgttcaactcgttgcgactattgttgcttcaactgtctccttcgggaccacatggtggttgctttcttcagtcgagaacatctgtaacacagatatgctcccaaagagtagtccgtggacttgccctggggatgtagtgttctacaacgcgtcgatcatttggggaatcatcggtcctggaaggatgttcacaagtaaaggtatataccccgggatgaactggttcttcctcattggcttccttgctcctgtcccggtctggttctttgcaaggaaattcccggagaagaagtggatacatcagattcatattcccttgatcttctcaggggctaatgtgatgccaatggccaaggctgtgcattactggtcgtggttcgctgttgggatcgtgttcaactactatatcttcaggaggtacaagggatggtgggcaaggcataactacatcctctctgcagctcttgatgcaggcactgcggttatgggagtgttgatctactttgcgttacagaacaataacataagcttaccagattggtgggggaatgagaacacagaccattgccctttggcaaattgcccaacagagaaagggatcgtcgctaagggctgcccggtgttctaaaaccttgttgcagtttaacattatctctgtagtttctcatacctgcaggtgagggacagttactgcaaagtcgtttggtggccataataataataatgcgtaaagactttgtgagagtttaagtgataaagtaaaaaatggtttgcaaattaagaacaccc

SEQ ID NO: 16 - protein, 753 aa, Arabidopsis thaliana
MVGSLEVSKPPEHKVESKIVIADEEEEDENDSPIEEVRLTVPITDDPSLPVLTFRTWFLGMVSCVVLAFVNNFFGYRSNPLTVSSVVAQIITLPLGKLMATTLPTTKLRLPGTNWSCSLNPGPFNMKEHVLITIFANTGAGGAYATSILTIVKAFYHRNLNPAAAMLLVQTTQLLGYGWAGMFRKYLVDSPYMWWPANLVQVSLFRALHEKEEKREGKQTKLRFFLIVFFLSFTYYIVPGYLFPSISYLSFVCWIWTRSVTAQQIGSGLHGLGIGSFGLDWSTVAGFLGSPLAVPFFAIANSFGGFIIFFYIILPIFYWSNAYEAKKFPFYTSHPFDHTGQRYNTTRILNQKTFNIDLPAYESYSKLYLSILFALIYGLSFGTLTATISHVALFDGKFIWELWKKATLTTKDKFGDVHTRLMKKNYKEVPQWWFVAVLAASFVLALYACEGFGKQLQLPWWGLLLACAIAFTFTLPIGVILATTNQRMGLNVISELIIGFLYPGKPLANVAFKTYGSVSIAQALYFVGDFKLGHYMKIPPRSMFIVQLVATIVASTVSFGTTWWLLSSVENICNTDMLPKSSPWTCPGDVVFYNASIIWGIIGPGRMFTSKGIYPGMNWFFLIGFLAPVPVWFFARKFPEKKWIHQIHIPLIFSGANVMPMAKAVHYWSWFAVGIVFNYYIFRRYKGWWARHNYILSAALDAGTAVMGVLIYFALQNNNISLPDWWGNENTDHCPLANCPTEKGIVAKGCPVF

SEQ ID NO: 17 - DNA, 2556 bp, Schizosaccharomyces pombe
  CDS (1)..(2556)
atgacagctcgcaattctgctagtattcctaccagtattaggaaaacatctgaaaatgaagtctctggagatgagacaccagctggagttgggaatttatctacaaagacggcctctaagacttcgctgacttttcgacagtcttcttctgacgagtcgacgagcagttatagtggaaaccaccataatattaacattcaacatcaccctaatcgtccttttcggaccaattcatcttcattcagtccaaatgactacagcataagtgaaagtcctagtaaatcgaagaaggatggcgtgcatgtctcagcggttcaacttgacaatgaaaccgactctgaagtcgagtcagaagtagaagagttggaacgtgaattagaagccattgaagattctgtttacccagaagttcgtgctgccgtaaatcctactgacgacgttaatttgcctgtgaacacttggagaacttgggtgcttaccaccatatttgtaatagttttcgctgctgtgaatcaattttttagtctacgttatccggctttgagcatcagtttcattgtcgctcaattaattttatttcctctaggaaaactattgaacttgttaccaaattggaagattggttatggtcgattctctttttatcttaattcttccccctttaacgttaaagaacatgcagccattacaatcgctgtttccctaacatcatctaccgcttatgccacgaatatcctgtccgcccaaactagcttctataaacaaaacctctcgtggggttataaaatacttattgtgcttacctcgcaaatgctgggttatggatttgccggtctcactagacgctggattgtgtatccagctgctatgatctggcctcaaactttagtaagcactgttctgtttagaacacttcacggtaatagtggaaatgacattggggtattaaaaaataacaggatatctgctaatggctggaccatttccagatatcgcttttttgcatatgtaatgattggatcatttgttttttactggtttcctgggttcatatttaaaggtctttcttattttaccgttctttgctggatatggccaaagaatcgtgttgtaaatcagttatttggatacaactccggtcttggcattcttccccttacattcgactggcagcaagtcgtttacaacagcaatccattggcttctccctggtgggtaatttgcaatacttttggatcggtggttttaattttttggattgtcgttcctatcttgtactataaaggtgtttggttctctaattatttacccatgctttcatcttcaacatttgatcacaccggtgtaagctacaactcttcacgtgttcttaatagtgattactcatttaatcatacaaaatatgaatcatattcacccttatatatgcctatgtcctatagcatgtcaactgctttgaattttgctgctgtgacagctattttcacacattgcgctttatacaatggaaaagatatatggcaacgcttatggaaagagtctggtaaagatgaatgcattcatcggaagctgatgcgcaattataaggaagcacctcagtggtggtatgccacattgttcatcgtagtctttggcttaaccattttcacagttcgttactatgatacgcaatgtcctgtgtgggctctcattgttgccttgttgatttttattgtaaatttcattcctcaaggtgttcttgaaggcattacaaatcagcatgtcggtctcaatattatcactgagctaattggcggttatattttacctgggaaacctttagctaatttgatgattaaactgtatgggttcattcctatgcggcaagggctagagttttctcgtgatcttaaactcgctcaatatatgaaaatacctccacgtatattattttttgttcagctttttgctacaatcctcggtggaattacccaggttgctgtacaggaatggatgaattatcacattccaggtatttgtacaacttcacaatcaaatggctttacttgtcccaacggtcgttccatctataatgcctccttaatttggggtgcaattgggcccgctaaaatgttttcaaaaggaaaaccatattacccattgatttttttctttttgataggtgcagttgctccttttataacatggggtttgagaaaaaggtttcctaagtcgtggattggaaagcttaatgctccggtccttttcactggtcctggcaatattcctcccgctactggaattaactattcttcttgggcaattgttgggtttatatttaattatgtgattagaaagcgcgcgatacactggtggaggaagtacaactacgtactggctgcagctatggattctggggttgcagtcgctggagtagtaattttcttatgtgtatcataccctggaggtaagataacctggtggggaaacactgtgtacactaaaacttatgattggaaaagtgtgccatataggtcacttgggccaaacgaaacctttggttacaccaattggtaa

SEQ ID NO: 18 - protein, 851 aa, Schizosaccharomyces pombe
MTARNSASIPTSIRKTSENEVSGDETPAGVGNLSTKTASKTSLTFRQSSSDESTSSYSGNHHNINIQHHPNRPFRTNSSSFSPNDYSISESPSKSKKDGVHVSAVQLDNETDSEVESEVEELERELEAIEDSVYPEVRAAVNPTDDVNLPVNTWRTWVLTTIFVIVFAAVNQFFSLRYPALSISFIVAQLILFPLGKLLNLLPNWKIGYGRFSFYLNSSPFNVKEHAAITIAVSLTSSTAYATNILSAQTSFYKQNLSWGYKILIVLTSQMLGYGFAGLTRRWIVYPAAMIWPQTLVSTVLFRTLHGNSGNDIGVLKNNRISANGWTISRYRFFAYVMIGSFVFYWFPGFIFKGLSYFTVLCWIWPKNRVVNQLFGYNSGLGILPLTFDWQQVVYNSNPLASPWWVICNTFGSVVLIFWIVVPILYYKGVWFSNYLPMLSSSTFDHTGVSYNSSRVLNSDYSFNHTKYESYSPLYMPMSYSMSTALNFAAVTAIFTHCALYNGKDIWQRLWKESGKDECIHRKLMRNYKEAPQWWYATLFIVVFGLTIFTVRYYDTQCPVWALIVALLIFIVNFIPQGVLEGITNQHVGLNIITELIGGYILPGKPLANLMIKLYGFIPMRQGLEFSRDLKLAQYMKIPPRILFFVQLFATILGGITQVAVQEWMNYHIPGICTTSQSNGFTCPNGRSIYNASLIWGAIGPAKMFSKGKPYYPLIFFFLIGAVAPFITWGLRKRFPKSWIGKLNAPVLFTGPGNIPPATGINYSSWAIVGFIFNYVIRKRAIHWWRKYNYVLAAAMDSGVAVAGVVIFLCVSYPGGKITWWGNTVYTKTYDWKSVPYRSLGPNETFGYTNW

SEQ ID NO: 19 - DNA, 2376 bp, Schizosaccharomyces pombe
  CDS (1)..(2376)
atgaaaactccaaaatttatcacttacgttactcgtggtttcaaaggacttgaatcgaaaagcgttgaaaacaacaaagaccatatcgtagaaaactcgagccctatcgcctcgaaatttcatgaattcgatgagcaaaagaaatcttttgaaatcataaattatgctggtcacgaaaagtttgttgacgacattactgaaagagaatcctcagtaccaggaaatgctgtttacgatattaccgtcagggacattgatgcaattgtacctgtaacggacgatgttgatatacccgcatcgactttcaggatgtggatactggcatttggtcttgctaccgttattgcaggcgttgatgctttctttttgatgcgttatccttcggtctccattgcagctatcgttgctcttcttgtagcatatccattgggtcagctctggtattatattattccacagtgggaaataaaactcccaaggggtatacgtgtttcacttaatccagggagattcaaccgaaaggaacatgcctgcctatatatattcgtcaacatttgtgtctccgcaaaactagttaacactttaattatcgaacaaataaagttttttggagttaacatcggaattggtagagccattttattcaatttatgtagttatctttcgtcattcggatggtcaggtctcgctttgccaattctagtgtatccgccaacattgatttggccttctgttttgagtagctgcgcacttttcaagatatttcacgacaatgataatactaaggcctgcaactggacaatctctcggcttcgttactttttcatagtttttgttgcttctttcatatggtattggtttcctgatctgatctttcctgctttaagctccttgggtgcttggatcagttggtgtaagccttccagtgcagttctatctcaaatatttggggtaaagactggactgggtcttttccctcttacgctcgactgggcccaaatttccagtttaagtaatcctttgatcactccctggtgggctacatgttgtatttttacatcctttgtgttttggatttggattgtacttccagggctttactatcaaaattactggcaagttgcgcatttccccattatgactaacagtatttacactgtttcggggaaaagttatgatgctcaaaaagtggttgattcgaaatgggagttggtaactcaaaagtatcaagaatattctccggttatgcttcctattgctttcatcataaacatagccttgtcattaggcgcattttcttcaatgatgatatcttttttccttcgttttcctaccgatgtcattcagccaatctgtcacgtttttaaatattcagacattcacactaaacttttaaagaaatataagcgtgttcattggggattttatttggcatcaataatagtttccttaggattaggcttcgcttttacagaaggatggcatgatattcagattagatcttatggatttgtggtctccatggttattggagcagctttgtacataccgctttcattaatcgagtctcgttccagcttcactataagtatgcaggcttttttcgaaatagtggcggctttctggtttaatggacaacctatggcattgctctacttctactcatttggatttgggacattacagcacgctatgcatatgactcaaagcgccaaaattggccattatatgaaagtccccccacggttagtcgctgctcttttgtttacaagtggaatttggtcatctctggttaattccgcagtaactggttggatcatgtatcacgttagagacgtgtgtacttcaaatgcggaaaataacatgacttgccgatctccaaaaactcaattcaatagtcatcttatctgggggttagttgggaatcacattttttcatcagatggtcgctattcatttgtaatgtggtttttccttgtaggtgctgtcgtttcagttgttgtttatttgcttcagataagttttcctaaaagctcttggaaacatgtcaatccagctctcctcctaggcggcgctgctcagataccgagtgtcacaggaatcaactattcaacctgggctgcagtcgccttttgtttcaattatttaattcgtcgtggttattattcgtggtggaagaaatataacttgataactgctgctgcaatggattgcggagtcgccattgctggactattcatatatttttgcgttgtatatactggtggttcaagtaactttagctggtggggaacgactgtaagttcggcgggatgtgacaaaaaaggttgtgctcatttatctgtttcggatattagcaaaccttctggatggtga

SEQ ID NO: 20 - protein, 791 aa, Schizosaccharomyces pombe
MKTPKFITYVTRGFKGLESKSVENNKDHIVENSSPIASKFHEFDEQKKSFEIINYAGHEKFVDDITERESSVPGNAVYDITVRDIDAIVPVTDDVDIPASTFRMWILAFGLATVIAGVDAFFLMRYPSVSIAAIVALLVAYPLGQLWYYIIPQWEIKLPRGIRVSLNPGRFNRKEHACLYIFVNICVSAKLVNTLIIEQIKFFGVNIGIGRAILFNLCSYLSSFGWSGLALPILVYPPTLIWPSVLSSCALFKIFHDNDNTKACNWTISRLRYFFIVFVASFIWYWFPDLIFPALSSLGAWISWCKPSSAVLSQIFGVKTGLGLFPLTLDWAQISSLSNPLITPWWATCCIFTSFVFWIWIVLPGLYYQNYWQVAHFPIMTNSIYTVSGKSYDAQKVVDSKWELVTQKYQEYSPVMLPIAFIINIALSLGAFSSMMISFFLRFPTDVIQPICHVFKYSDIHTKLLKKYKRVHWGFYLASIIVSLGLGFAFTEGWHDIQIRSYGFVVSMVIGAALYIPLSLIESRSSFTISMQAFFEIVAAFWFNGQPMALLYFYSFGFGTLQHAMHMTQSAKIGHYMKVPPRLVAALLFTSGIWSSLVNSAVTGWIMYHVRDVCTSNAENNMTCRSPKTQFNSHLIWGLVGNHIFSSDGRYSFVMWFFLVGAVVSVVVYLLQISFPKSSWKHVNPALLLGGAAQIPSVTGINYSTWAAVAFCFNYLIRRGYYSWWKKYNLITAAAMDCGVAIAGLFIYFCVVYTGGSSNFSWWGTTVSSAGCDKKGCAHLSVSDISKPSGW

SEQ ID NO: 21 - DNA, 2352 bp, Candida albicans
  CDS (1)..(2352): transl_table=12
atggacaaaataagggcagtaattagtggaggtgagaaacctcccgttgacactgacaacgatcacaacacagactttgaggctgacagaaaaatgccagatttggatattgtagtttccaaatcacaagaatttgacccagtcacctcccacttggttaatgatattatggaagatgaatatgctgctgtccatgttgaagatgattctccttatccagaagttagagcagctgttccttctactgacgacccaactttacctcaaaataccattagagcctgggttattggtttgatattgactacggttggttgtggtatgaatatgttgttcagtttccatagtccctcatttgctatcaccacttttgtcacatccattttggcttggccaattgggaacttttgggcatggattgttcctgactggaagatttttggtgcttcgttaaatccaggtccattcaacgttaaagaacatactatcatcactattatggccaacgtttcttttggtactggtgccgcatatgccacagatatcttgcttgcacaaaatatgttttataaatcaaattttggttgggggtacaatttattacttatctggagtacccaatgtattgggtttgctttcggaggtgttatgagaagatttgttgttgacagtccaggggccatctggcccctgaatttggtcaccgcaacattcttgactaatatgcacattaacgaaaaccacactgctaatggctggaaaatttctcgtcttgcatttttcgtgatcgtgtttgttgcctcatttgtttggtattggttcccaggttatattttccaggctttatcgtatttttcttggatcacctggattaaaccaaacaatgtcattatcaatcaagttttcggttcttcatctgggttaggtatgattcctaacaacattgccttggactggaaccaaattgcagggtatattgggtctccattgattccaccagctagtgttattgctacaatttttggatccattgtgcttattttctggattgttgtgccagctattcactattccaacacttggtactcccaatacttgccaatctcatctactggatcgtttgataggttccaacaaacttataatgtgtcaaaaattatcgaccataaaactttatcattcaatgaagcggaatacaaaaagtactcccctttgtttttatccaccacctttgccatttcctatgggctatcatttgcctccattttagccactataacacacaccatttgcttccatggacgtgaccttatcgcatcgttgaaggccaaagaaaaaccagatgttcacaatagattaatgaaagcatacaaaccagtgcctgaatggtggtacctagttgtcttcttggtctttttcggtatgtccatagccaccgtacgtgcttggcctactgaaatgccagtatgggggttagtttttgctcttatcatcgctatcatatttttattacccgttgctatcatttatgcaaaaacgaatattgctgttggtttaaacgttgtaaccgagttcatcgtgggctacgtactaggtggacgtcccctatgtatgatgttgttcaagaccttcggatacatcactaataaccaagctgttacttttgtgcaggatatgaaacttgggcactacatgaaaatagatccgcgcactttgttttgggcgcagtttgctgctaccatatggggatcgttagttcagatcgcagttttggagtgggcctatggtgcaatcgacaatttgtgtgctgctgaccaaaaaaatcattacacatgtccaaacggtaaagttttcttcaatgcttcgatcatttggggtgtcattggaccccaacgtcaattctcacatgggcagatttattatgggttacttttctttttcatcattggtgctgtgacccctgtcatcaattggttgatcttgaaaaaatggccaaactctccagtcaagtatttgcattggccagtgttcttttctgggacagggtacattcctccagccactccatataactatacctcctactgtgctgtgggtttgttctttggatggtggattaaaaagaagtggttccactggtggtctaaatacaactattccttgtctgcgggcttggatattggtttggcatggtgctcgttgatcattttcttgtgcttgagtttaacaaacaccgacttcccatcgtggtggggaaacgatgtgatcaacaccactctcgacactcaggttgtcaccaatatcagacacatattgaaagagggagaggcatttgggccatcttcctggtaa

SEQ ID NO: 22 - protein, 783 aa, Candida albicans
MDKIRAVISGGEKPPVDTDNDHNTDFEADRKMPDLDIVVSKSQEFDPVTSHLVNDIMEDEYAAVHVEDDSPYPEVRAAVPSTDDPTLPQNTIRAWVIGLILTTVGCGMNMLFSFHSPSFAITTFVTSILAWPIGNFWAWIVPDWKIFGASLNPGPFNVKEHTIITIMANVSFGTGAAYATDILLAQNMFYKSNFGWGYNLLLIWSTQCIGFAFGGVMRRFVVDSPGAIWPSNLVTATFLTNMHINENHTANGWKISRLAFFVIVFVASFVWYWFPGYIFQALSYFSWITWIKPNNVIINQVFGSSSGLGMIPNNIALDWNQIAGYIGSPLIPPASVIATIFGSIVLIFWIVVPAIHYSNTWYSQYLPISSTGSFDRFQQTYNVSKIIDHKTLSFNEAEYKKYSPLFLSTTFAISYGLSFASILATITHTICFHGRDLIASLKAKEKPDVHNRLMKAYKPVPEWWYLVVFLVFFGMSIATVRAWPTEMPVWGLVFALIIAIIFLLPVAIIYAKTNIAVGLNVVTEFIVGYVLGGRPLCMMLFKTFGYITNNQAVTFVQDMKLGHYMKIDPRTLFWAQFAATIWGSLVQIAVLEWAYGAIDNLCAADQKNHYTCPNGKVFFNASIIWGVIGPQRQFSHGQIYYGLLFFFIIGAVTPVINWLILKKWPNSPVKYLHWPVFFSGTGYIPPATPYNYTSYCAVGLFFGWWIKKKWFHWWSKYNYSLSAGLDIGLAWCSLIIFLCLSLTNTDFPSWWGNDVINTTLDTQVVTNIRHILKEGEAFGPSSW

SEQ ID NO: 23 - DNA, 2166 bp, Zea mays
  CDS (1)..(2166)
atggaggaggtggcgctggtggtgccggagacggacgacccgtcgatgcccgtgatgacattccgggcgtgggcgctggggctcggctcctgcgtcgtcctcatcttcctcaacaccttcttcacgtaccgcacccagccgctcaccatctcggggatcctggcgcagatcctcgtgctccccgcagggcgcttcctggccgccgtgctgcccgaccgcgaggtcaggatcctcggcggcaggctcggcagcttcaacctcaacccggggcccttcaacgtcaaggagcacgtcatcatcaccatcttcgccaactgcggcgtctcctacggcggcggcgacgcttactccatcggcgccatcaccgtcatgaaggcctactacaagcagacgctcagcttcgcatgcgccctcctcatcgtcctcaccacacagatactggggtacggctgggctgggttgctgaggaggtacctggtcgaccctgccgagatgtggtggccttctaaccttgcccaggtctcactcttcagggcgctgcacgagaaagaagaggagggcggcaagtcccgtggcccgtcgcggatgcgcttcttcctcatcgtcttcttcgcgagcttcgcgtactacgcgctgccggggtacctgctgccgatcctgaccttcttctcgtgggcgtgctgggcgtggccgcacagcatcacggcgcagcaggtcgggtccgggtaccacggcctcggcgtcggcgcattcacgctcgactgggcgggcatctcggcgtaccacggcagcccgctggtggcgccgtgggcgtccatcgccaacacggccgtgggattcgtcatgttcatctacgtcatcgtgccgctctgctactggcagttcaacacgttcgacgcccgcaggttccccatcttctccaaccagctcttcacggcgtcgggccagaagtacgacaccaccaaggtgctcaccaaggacttcgacctcaacgtcgccgcctacgacagctacgggaagctctacctcagcccgctcttcgccatctccatcggctccggcttcctgcggttcacggccaccattgtccacgtcctgctcttccatggcagcgacatgtggaagcagagcaagtcggccatgaacgcggtgaagccggacgtgcacgccaagctgatgcagaggtacaggcaggtgccgcagtggtggttcctcatgctgctgctgggcagcgtggtggtgtccctgctcatgtccttcgtctggaaggaggagatgcagctgccgtggtgggggatgctcttcgccttcgcgctcgccttcgtcgtcaccctccccatcggcgtcatccaggccaccactaaccagcaaccggggtacgacatcatcgcgcagttcatgatcggctacgcgctgcccggcaagcccatcgccaacctgctcttcaagatctacggccggatcagcaccgtgcacgcgctatcgttcctcgcagacctcaagctcggccactacatgaagatccccccacggtgcatgtacacggcccagctggtcgggacggtggtcgccggcgtggtgaacctggcggtggcgtggtggatgctggacaacatcgagaacatctgcgacgtggaggcgctgcacccggacagcccgtggacgtgccccaagtaccgcgtcacgttcgacgcgtcggtgatctggggcctgatcggcccggggcggctcttcggccagcacgggctgtaccgcaacctggtgtggctgttcctggtcggcgcggtgctccccgtgccggtgtggctgctgagcagggcgttcccggagaagaagtggatcgcactcatcaacgtgcccgtcatctcgtacgggttcgccgggatgccgccggccacgcccaccaacatcgccacctggctggtgacgggcaccatcttcaactacttcgtcttcaggtaccgcaaggggtggtggcagaagtacaactacgtgctatcggcggcgctcgacgccggcaccgccttcatgggtgtgctcatcttcttcgccctccagaacgcgcaccacgagctcaagtggtggggcacggaggtggatcactgcccactcgcctcctgcccccccgcgccgggcatcgccgtcaagggctgcccggtgttttga

SEQ ID NO: 24 - protein, 721 aa, Zea mays
MEEVALVVPETDDPSMPVMTFRAWALGLGSCVVLIFLNTFFTYRTQPLTISGILAQILVLPAGRFLAAVLPDREVRILGGRLGSFNLNPGPFNVKEHVIITIFANCGVSYGGGDAYSIGAITVMKAYYKQTLSFACALLIVLTTQILGYGWAGLLRRYLVDPAEMWWPSNLAQVSLFRALHEKEEEGGKSRGPSRMRFFLIVFFASFAYYALPGYLLPILTFFSWACWAWPHSITAQQVGSGYHGLGVGAFTLDWAGISAYHGSPLVAPWASIANTAVGFVMFIYVIVPLCYWQFNTFDARRFPIFSNQLFTASGQKYDTTKVLTKDFDLNVAAYDSYGKLYLSPLFAISIGSGFLRFTATIVHVLLFHGSDMWKQSKSAMNAVKPDVHAKLMQRYRQVPQWWFLMLLLGSVVVSLLMSFVWKEEMQLPWWGMLFAFALAFVVTLPIGVIQATTNQQPGYDIIAQFMIGYALPGKPIANLLFKIYGRISTVHALSFLADLKLGHYMKIPPRCMYTAQLVGTVVAGVVNLAVAWWMLDNIENICDVEALHPDSPWTCPKYRVTFDASVIWGLIGPGRLFGQHGLYRNLVWLFLVGAVLPVPVWLLSRAFPEKKWIALINVPVISYGFAGMPPATPTNIATWLVTGTIFNYFVFRYRKGWWQKYNYVLSAALDAGTAFMGVLIFFALQNAHHELKWWGTEVDHCPLASCPPAPGIAVKGCPVF

SEQ ID NO: 25 - DNA, 2256 bp, Oryza sativa
  CDS (1)..(2256)
atgggtgaggcagcggcggacgagcgcggcctcgccgccgccgccgccggggaagacgaggaggagacgtcgccgatcgaggaggtgcggctgacggtgccggccggcgacgacacggcgctgccggtgtggacgttccggatgtggagcatcggcctcctctcctgcgcgctcttgagcttcctcaaccagttcttctcctaccgcaccgagccgctcatcgtgacgcagatcacggtgcaggtggcgtcgctgccggtgggccacttcctggcgcgcgtgctgccgcgccgcgcgttccgcgcccccgcgctgctcggcggcggcgagtggagcctcaacccgggccccttcaacatgaaggagcacgtgctcatctccatcttcgccaacgccggctgcgccttcggcaacggcaacgcctacgccgtcatgatcgtcgacatcatccgcgccttctacaagcgctccatctccttcgtcgccgcctggctcctcatcatcaccacccaggtgcttgggtacgggtgggcggggctgatgcgcaagttcgtggtggagccggcgcacatgtggtggccggggacgctcgtccaggtctcgctcttccgggcactgcacgagaaggatgagttgccccatgggtcacggcagatatcccgctccaagttcttcctggtggcgctcatctgcagctttgcttggtacgccgtaccgggttacctcttcccgacgctgacatccatctcatgggtgtgctgggtcttctccaagtccgtcacggcgcaacagctgggctccggcttgaagggcttgggcgttggggccttctcgctcgactggacagctatctcttccttcctcttcagcccgctcatctcgcccttctttgccaccgccaacatcttcgtcggcttcgtgctcttcctctatgtgctcgttcccatagcatactggggtttcgacctgtacaatgccaagacattccccatcttctcctcgcacctattcatgtccaatggcacgagctacgatatcacagccatcgtgaacgacaagtttgagcttgatatcgatgcttacaataagcttggcaggatcaacctcagtgtgttcttcgcgctcgcttatggtctaagttttgccaccattgcctccactgtcacccacgtcggcctcttctatggaaaggaaatctatcaccgttttcgagcttcgcagaaggagaagcctgatatccacactaggctgatgaagaagtacgatgacataccagtgtggtggttctactcactgatggcgctttcgatgacagtggcacttatcctctgcactgtcctgaagcatgaggtccagcttccatggtggggtctactatttgcctgtggcatggccttcatcttcaccctacccatcagcatcatctctgcgacaaccaaccaggcaagctatacacctggtctgaacgtcatcacggagtatgccattgggttgataatccctggtcatcccatcgccaacgtctgtttcaaggtgtatggctacatgagcatgtctcaggctattgccttcctctcagacttcaaacttggccactatatgaagattcccccaaaatccatgttcctagttcagtttattggcacaattgtggccggcacggtcaaccttggggtggcatggtggctgctcggctccatccatgacatttgtcaggattcgctcccagctgacagcccatggacatgccccaacgaccgagtcttcttcgatgcatcggtcatttggggcctcattggcccaatccgcatctttggaccacatggcaactacagtgccctcaactggttcttcctcatcggcgcagcaggccctgttatcgtgtacatcttccacaagatgttcccaaacaagaaatggataacactgactaacttaccagtgctcatcggcgcgacagcctcaatgccaccggcgacggctgtgaattacaactcttggctgctctttggtaccatcttcaatttcttcgtgttccggtaccggaagaagtggtgggagaggtacaactacattctctctgccgcactcgacgctggcgtggctttcatggcggtgctgctgtacttctcactatccatggagaaccggagcatcgactggtggggcacggcaggagaacactgcccactggccacatgtcccactgcaaaaggggttgacttgggtccaacaagcgtttgccctgtgttctaa

SEQ ID NO: 26 - protein, 751 aa, Oryza sativa
MGEAAADERGLAAAAAGEDEEETSPIEEVRLTVPAGDDTALPVWTFRMWSIGLLSCALLSFLNQFFSYRTEPLIVTQITVQVASLPVGHFLARVLPRRAFRAPALLGGGEWSLNPGPFNMKEHVLISIFANAGCAFGNGNAYAVMIVDIIRAFYKRSISFVAAWLLIITTQVLGYGWAGLMRKFVVEPAHMWWPGTLVQVSLFRALHEKDELPHGSRQISRSKFFLVALICSFAWYAVPGYLFPTLTSISWVCWVFSKSVTAQQLGSGLKGLGVGAFSLDWTAISSFLFSPLISPFFATANIFVGFVLFLYVLVPIAYWGFDLYNAKTFPIFSSHLFMSNGTSYDITAIVNDKFELDIDAYNKLGRINLSVFFALAYGLSFATIASTVTHVGLFYGKEIYHRFRASQKEKPDIHTRLMKKYDDIPVWWFYSLMALSMTVALILCTVLKHEVQLPWWGLLFACGMAFIFTLPISIISATTNQASYTPGLNVITEYAIGLIIPGHPIANVCFKVYGYMSMSQAIAFLSDFKLGHYMKIPPKSMFLVQFIGTIVAGTVNLGVAWWLLGSIHDICQDSLPADSPWTCPNDRVFFDASVIWGLIGPIRIFGPHGNYSALNWFFLIGAAGPVIVYIFHKMFPNKKWITLTNLPVLIGATASMPPATAVNYNSWLLFGTIFNFFVFRYRKKWWERYNYILSAALDAGVAFMAVLLYFSLSMENRSIDWWGTAGEHCPLATCPTAKGVDLGPTSVCPVF

SEQ ID NO: 27 - DNA, 2879 bp, Oryza sativa
  CDS (593)..(2794)
gaggggagaaacaagcctacagatgatggctcggtctatcccgccggagtccggtgacgagaacgtctcggcttctgccgatggtgtgtatgcctccttgttcattctctgcatgaattgcctttcctacactgggaatgcaaatgaaattctctcgtggtagaagatcgaaattaagctactagctagtttctcttggagaatgaaatcaacaacagttttcttccacttcccatttgttcgtgcaaaattgctgctaaaatatttaacgattttactcatgtttctttttttttccccaatggaatctgaacggctcagtgttgctttgctaaaaacatgagggtttgagaacttctctcgcaaagacatgcaggcggcctattttagggacagaagatgacaaaagaacatcaaggaagagggcgtacgtgtagagaaagacggtgaaatattttgccagccagccggccggccggagtccgacgatcgagcacattccgatggacactgcaggcggtacaacaaaccacgcctaaaacctcctttacttagttttgtgtgtgtgtgtgtgcgcactgcagaggagggcatggaggaggaggtgaacgaccacccgatcgaggaggtccggaacacggtgccggtgaccgacgacccgtcggagccgtgcctgacgttccgggtgtgggtgctggggctctcgtcgtgcgtgttcctcgccttcgtcaacgagttcttcatgtaccggaccacgcagctgagcatcggcacggtggtggtgcaaatcatcacgctgcccatcggccgcctcatggcgtcgacgctgccggcgaggcgcctccgcgtcggcggctggtccttctccctcaacccggggcccttcagcctcaaggagcattgcctcatcatcatcttcgccggcgccggcgccagcggcgtctatgccatgaacatcatcgccatcgtcaaggtgttctacaagcgccagatcagcccctacgccgccatgctgctcgcccagaccacccagttgcttgggtatggatgggccggattgttcaggaagtacctggttgactcagcctacatgtggtggccgtcaaacctcgtccaagtcaccctcttcagggcgatgcacgaggaggagaagaggaacaaggggcagctgacgcggctgcagttcttcatcatggtgatgacgtgcagcttcgcctactatatcgtacccagctacctgttcccggcgatcagcaccatctcggtgctgtgctggctgtacagggactcggtgacggcgcagcagatcggctccggcgcctcgggcctcggcgtcggctccttcggcctcgactggaacaccgtggtgggcttcctcggcaacccgctggcgtcgccggcgttcgccatcttcaacgtcatggccggcttcgcgctcagcacctacgtcgccgtgccgatcctctactggaccgacacctacaacgccaagcgcttcccgctcgtgtcgtcgcacgtcttcaacgccgccggcggccgctacgacaccgcccgcatcctcgacccggccaccttcacgctcaacctcagggagtacgacgcctacggccgcatcaacctcagcatcctcttcgccatcaactacggcatcggcttcgcgggcctcatgtccacgctctcccacgtcgcgctctaccacggcaaggacatttggggcttgtggcggaaggcaacggcggagcaggcgaacggcggcggcaaggagcgccaagacgtgcacacgagaatcatgaagaggaactacaaggccgtgccacagtggtggtttcacttgatgctggccatcgtgatggcattgtcgctgtacacctgtgaggggtttggccggcagcttcagctgccatactggggtctcctccttgcctgtgccatcgccttcaccttcacgttgcccatcggcgtcatctctgccacgaccaacatgcaaccagggttaaacatcatcacagagctcatcatcgggtacctgtacccggggaagccattggcgaatgtggtgttcaagacctacggctacataagcatgactcaggcgctgacgtttgtgtcggatttcaagctggggcactacatgaagataccgcccaggtccatgttcatggtgcagctggcagggacggtggtggcgtcgacggtgcacttcgcgacggcgtggtggctgctgacgacggtgaggaacatctgcgacgtggacagcctgccgctggggagcccgtggacgtgccccggcgaggacgtcttctacaacgcctccatcatctggggcgtcgtcggaccgctccggatgtttggccgtctcggcaactactggcagatgaactacttcttcctcgtcggcgtcctcgcgccggtgcccgtctggctgctgtcgcgccggtacccgcgcagcgcgttgctccgggacatcaacctgccgctcgtcctcgccggcgccagcgggctgctcccggcgaggtccgtcaacttcgtcatgtgggggctcgtcgggttcgtgttcaaccacgtcgtgtaccgccggtgcagggcgtggtggatgcggcataactacgtgctcgccgcggggctcgacgccggcgtcgccttcatgggcgtgctcaccttcgtctcgctaggatacttcgacatatacggggtgcagtggtggggtggcgccgccgatgatcactgccccttggcgtcgtgccccacagcacctggggtgtttgccaggggatgcccgcctgtaccttcttgattgatcaggacaccgcatctacatgtatatactccatatgacagatggttactcaaatgtatatattatatcctcttgtcttcct

SEQ ID NO: 28 - protein, 733 aa, Oryza sativa
MEEEVNDHPIEEVRNTVPVTDDPSEPCLTFRVWVLGLSSCVFLAFVNEFFMYRTTQLSIGTVVVQIITLPIGRLMASTLPARRLRVGGWSFSLNPGPFSLKEHCLIIIFAGAGASGVYAMNIIAIVKVFYKRQISPYAAMLLAQTTQLLGYGWAGLFRKYLVDSAYMWWPSNLVQVTLFRAMHEEEKRNKGQLTRLQFFIMVMTCSFAYYIVPSYLFPAISTISVLCWLYRDSVTAQQIGSGASGLGVGSFGLDWNTVVGFLGNPLASPAFAIFNVMAGFALSTYVAVPILYWTDTYNAKRFPLVSSHVFNAAGGRYDTARILDPATFTLNLREYDAYGRINLSILFAINYGIGFAGLMSTLSHVALYHGKDIWGLWRKATAEQANGGGKERQDVHTRIMKRNYKAVPQWWFHLMLAIVMALSLYTCEGFGRQLQLPYWGLLLACAIAFTFTLPIGVISATTNMQPGLNIITELIIGYLYPGKPLANVVFKTYGYISMTQALTFVSDFKLGHYMKIPPRSMFMVQLAGTVVASTVHFATAWWLLTTVRNICDVDSLPLGSPWTCPGEDVFYNASIIWGVVGPLRMFGRLGNYWQMNYFFLVGVLAPVPVWLLSRRYPRSALLRDINLPLVLAGASGLLPARSVNFVMWGLVGFVFNHVVYRRCRAWWMRHNYVLAAGLDAGVAFMGVLTFVSLGYFDIYGVQWWGGAADDHCPLASCPTAPGVFARGCPPVPS

SEQ ID NO: 29 - DNA, 2259 bp, Oryza sativa
  CDS (1)..(2259)
atggagcaaccacggcttgagctcagcagcctggaaggtcaccggagtagcgaaaatccagagagcagagatgagaaaaccgaagaggaggtagacgactgcccgatcgaggaggtgcggctgacggtgccgatcaccgacgacccggcattgccggcgctgacgttcaggacatggctgctggggctcatctcctgcgcgatgctggccttctccaaccagttcttcggctaccggcagaatccgctctacatctcgtcgctgtccgtgcagatcgtcgtcttgccgctgggcaagctgatggctgcttgcctccccaagaaggtgttcagggtgaagggcacggcatggtcgttctcgctcaacccggggccgttcaacctcaaggagcatgtgctcatcaccatcttcgccaacaccggatccaactccgtctacgccgtcggcattatcaccattgttaaggccttctaccgccgggagattcatcctcttgctgccatgctgctcacccagacaacccagctgatgggatatggttgggctggcctcttcagaaagtttcttgtggactcaccttacatgtggtggccttcaaacttggtacaggtttcactcttcagagctctgcatgagaaggagaagaggccaaagggagggacgacgaggctgcagttcttcctgaccgtgctcatcaccagcttcgcctactacattgtgccgaactacctgttcccgaccatctccaccatctcggtggtgtgcctggtgtggaagaagtcggtgacggcgcagcagatcggctccggcgtgtacggcctgggcgtcggctcgttcggcctggactgggcgacggtggccggcttcctcggcacgccgctgtcgacgccggcgttcgccatcgtcaacatcatggccggcttcttcctcatcgtctacgtgatcgtgccggcggcgtactgggccgacgcgtacggcgccaagcggttcccgatcatctcctcccacgtgttctccgccaacggcagccggtacgacgtcaaccaggtgctcgacacggcgacgttcgagttcagccaggccgggtacgacgccgcgggcaagatcaacctgagcatcttcttcgccttcacctacggcctcagcttcgccacgctcgccgcgacgctgtcgcacgtcgcgctcttccacggcgggtcgatatggcggcagaccaaggcggcggtgagcgggcagggcggcgacgtgcacaccaggctgatgaagcgcaactacgccgcggtgccgcagtggtggttccaggtgatgctcgtcgccgtgctcggcctctccgtgttcacctgcgagggcttcggccagcagctgcagctcccgtactggggcgtcctcctcgccgccggcctcgccttcttcttcaccctccccatcggcatcatcaccgccaccaccaatcagcaacctgggctgaacgtgatcaccgagctgatcatcggatacctgtacccggggaggccgctcgccaacgtcgccttcaagacgtacggctacatcagcatgtcccaggcgatcatgttcttgcaggatttcaagctgggccactacatgaagatcccaccacgctccatgttcatcgtccagctcgtcgggacggtgctggcgtcgtcggtgtacttcgggacgtcgtggtggctgctggagagcgtgagcaacatctgcgacccggcgaagctgccggaggggagcccgtggacgtgccccggcgacgacgtcttcttcaacgcctccatcatctggggggtggtcggcccgctgcggatgttcggccgcctcggcctgtacgccaagatgaactacttcttcctcgccggcgcgctggcgccggtgccggtgtgggcgctgtcgcgggcgttcccgggcagggcgtggatcgggctcgtcaacatgccggtgctcctcggcgccacggggatgatgccgccggcgaggtcggtgaactacctcatgtggggcgccgtggggctcgccttcaactacgtcgtgtaccgccggtacaaggggtggtgggcgcggcacaactacgtgctgtccgccgggctggacgccggcgtggccttcatggggatcctctcgtacgccgtgctgcagtcgaggggcatcaatggcgtcaactggtgggggctgcaggtggacgaccactgcgccctggctcgttgccccacggcgcccggggtcagcgcccccggctgcccggtgcagtga

SEQ ID NO: 30 - protein, 752 aa, Oryza sativa
MEQPRLELSSLEGHRSSENPESRDEKTEEEVDDCPIEEVRLTVPITDDPALPALTFRTWLLGLISCAMLAFSNQFFGYRQNPLYISSLSVQIVVLPLGKLMAACLPKKVFRVKGTAWSFSLNPGPFNLKEHVLITIFANTGSNSVYAVGIITIVKAFYRREIHPLAAMLLTQTTQLMGYGWAGLFRKFLVDSPYMWWPSNLVQVSLFRALHEKEKRPKGGTTRLQFFLTVLITSFAYYIVPNYLFPTISTISVVCLVWKKSVTAQQIGSGVYGLGVGSFGLDWATVAGFLGTPLSTPAFAIVNIMAGFFLIVYVIVPAAYWADAYGAKRFPIISSHVFSANGSRYDVNQVLDTATFEFSQAGYDAAGKINLSIFFAFTYGLSFATLAATLSHVALFHGGSIWRQTKAAVSGQGGDVHTRLMKRNYAAVPQWWFQVMLVAVLGLSVFTCEGFGQQLQLPYWGVLLAAGLAFFFTLPIGIITATTNQQPGLNVITELIIGYLYPGRPLANVAFKTYGYISMSQAIMFLQDFKLGHYMKIPPRSMFIVQLVGTVLASSVYFGTSWWLLESVSNICDPAKLPEGSPWTCPGDDVFFNASIIWGVVGPLRMFGRLGLYAKMNYFFLAGALAPVPVWALSRAFPGRAWIGLVNMPVLLGATGMMPPARSVNYLMWGAVGLAFNYVVYRRYKGWWARHNYVLSAGLDAGVAFMGILSYAVLQSRGINGVNWWGLQVDDHCALARCPTAPGVSAPGCPVQ

SEQ ID NO: 31 - DNA, 2289 bp, Oryza sativa
  CDS (1)..(2289)
atgattaaaagccctctccgggttatcagccataatcactatcagagttttgtgtgtgtgtgtgtgcgcactgcagaggagggcatggaggaggaggtgaacgaccacccgatcgaggaggtccggaacacggtgccggtgaccgacgacccgtcggagccgtgcctgacgttccgggtgtgggtgctggggctctcgtcgtgcgtgttcctcgccttcgtcaacgagttcttcatgtaccggaccacgcagctgagcatcggcacggtggtggtgcaaatcatcacgctgcccatcggccgcctcatggcgtcgacgctgccggcgaggcgcctccgcgtcggcggctggtccttctccctcaacccggggcccttcagcctcaaggagcattgcctcatcatcatcttcgccggcgccggcgccagcggcgtctatgccatgaacatcatcgccatcgtcaaggtgttctacaagcgccagatcagcccctacgccgccatgctgctcgcccagaccacccagcagttgcttgggtatggatgggccggattgttcaggaagtacctggttgactcagcctacatgtggtggccgtcaaacctcgtccaagtcaccctcttcagggcgatgcacgaggaggagaagaggaacaaggggcagctgacgcggctgcagttcttcatcatggtgatgacgtgcagcttcgcctactatatcgtacccagctacctgttcccggcgatcagcaccatctcggtgctgtgctggctgtacagggactcggtgacggcgcagcagatcggctccggcgcctcgggcctcggcgtcggctccttcggcctcgactggaacaccgtggtgggcttcctcggcaacccgctggcgtcgccggcgttcgccatcttcaacgtcatggccggcttcgcgctcagcacctacgtcgccgtgccgatcctctactggaccgacacctacaacgccaagcgcttcccgctcgtgtcgtcgcacgtcttcaacgccgccggcggccgctacgacaccgcccgcatcctcgacccggccaccttcacgctcaacctcagggagtacgacgcctacggccgcatcaacctcagcatcctcttcgccatcaactacggcatcggcttcgcgggcctcatgtccacgctctcccacgtcgcgctctaccacggcaagcaaatttggggcttgtggcggaaggcaacggcggagcaggcgaacggcggcggcaaggagcgccaagacgtgcacacgagaatcatgaagaggaactacaaggccgtgccacagtggtggtttcacttgatgctggccatcgtgatggcattgtcgctgtacacctgtgaggggtttggccggcagcttcagctgccatactggggtctcctccttgcctgtgccatcgccttcaccttcacgttgcccatcggcgtcatctctgccacgaccaacatgcaaccagggttaaacatcatcacagagctcatcatcgggtacctgtacccggggaagccattggcgaatgtggtgttcaagacctacggctacataagcatgactcaggcgctgacgtttgtgtcggatttcaagctggggcactacatgaagataccgcccaggtccatgttcatggtgcagctggcagggacggtggtggcgtcgacggtgcacttcgcgacggcgtggtggctgctgacgacggtgaggaacatctgcgacgtggacagcctgccgctggggagcccgtggacgtgccccggcgaggacgtcttctacaacgcctccatcatctggggcgtcgtcggaccgctccggatgtttggccgtctcggcaactactggcagatgaactacttcttcctcgtcggcgtcctcgcgccggtgcccgtctggctgctgtcgcgccggtacccgcgcagcgcgttgctccgggacatcaacctgccgctcgtcctcgccggcgccagcgggctgctcccggcgaggtccgtcaacttcgtcatgtgggggctcgtcgggttcgtgttcaaccacgtcgtgtaccgccggtgcagggcgtggtggatgcggcataactacgtgctcgccgcggggctcgacgccggcgtcgccttcatgggcgtgctcaccttcgtctcgctaggatacttcgacatatacggggtgcagtggtggggtggcgccgccgatgatcactgccccttggcgtcgtgccccacagcacctggggtgtttgccaggggatgcccgcctgtaccttcttga

SEQ ID NO: 32 - protein, 762 aa, Oryza sativa
MIKSPLRVISHNHYQSFVCVCVRTAEEGMEEEVNDHPIEEVRNTVPVTDDPSEPCLTFRVWVLGLSSCVFLAFVNEFFMYRTTQLSIGTVVVQIITLPIGRLMASTLPARRLRVGGWSFSLNPGPFSLKEHCLIIIFAGAGASGVYAMNIIAIVKVFYKRQISPYAAMLLAQTTQQLLGYGWAGLFRKYLVDSAYMWWPSNLVQVTLFRAMHEEEKRNKGQLTRLQFFIMVMTCSFAYYIVPSYLFPAISTISVLCWLYRDSVTAQQIGSGASGLGVGSFGLDWNTVVGFLGNPLASPAFAIFNVMAGFALSTYVAVPILYWTDTYNAKRFPLVSSHVFNAAGGRYDTARILDPATFTLNLREYDAYGRINLSILFAINYGIGFAGLMSTLSHVALYHGKQIWGLWRKATAEQANGGGKERQDVHTRIMKRNYKAVPQWWFHLMLAIVMALSLYTCEGFGRQLQLPYWGLLLACAIAFTFTLPIGVISATTNMQPGLNIITELIIGYLYPGKPLANVVFKTYGYISMTQALTFVSDFKLGHYMKIPPRSMFMVQLAGTVVASTVHFATAWWLLTTVRNICDVDSLPLGSPWTCPGEDVFYNASIIWGVVGPLRMFGRLGNYWQMNYFFLVGVLAPVPVWLLSRRYPRSALLRDINLPLVLAGASGLLPARSVNFVMWGLVGFVFNHVVYRRCRAWWMRHNYVLAAGLDAGVAFMGVLTFVSLGYFDIYGVQWWGGAADDHCPLASCPTAPGVFARGCPPVPS

SEQ ID NO: 33 - DNA, 2634 bp, Ashbya gossypii
  CDS (1)..(2634)
atggactttcaacaggtggataccaaagaaaagaactccgacaggttaccatccccttgtgctccggcctctgagaaagatggaaaggctggctcgcaggatgtgccattgtccgacactcaggaactttcgctgctagacgatgaacaccttattctccttcttcacaagatgggctacaaacacgcggacttggaagatattccgccggttgttcactatcttgtagcacggataaatgaattgacaatagaaaagtcactgacgatattgaaaaagtgtgccgttgaccacgctggtgatccgaatatcacggaggaggaagctaccgacctagagcgctttacttctggcgactttgaccacaccgatgagacagaagtctttcagttgaagctacttgctgcattattctactaccactcgccctatcccgaggttcgggcggttgtgggtcccggagatgatcccactatcccagtggaaacgttccgctgttacttcctgaccaccaccattactattattggctgtggactgacaacctttttccaatcccgttatccgttaatcgaattctcctcgatggcggcgcagtttttgttcttcatactgggaacgttatggtcgaaatttatgcctgcagttaggatacccatatttccaggttatggtttccaattgaatttgcagacttcttggtccaagaaggaacaaatgtttgccacgctgctgtacagtattactacaggcgtcttctattcttattttaatatcttgacgcaagatatgttttataatgatcccacatcgttagggttccaaataatcctatctctatcgctacagttcatggggttcggacttgcgggtcttctgaggcctttcgtggttttccccgcacgcgcactttggccattatctatgcccacaatagctttgaacaatgcactacttgcccaagatgtgggaaaaggtactagtatcaggaaagttttcttttactttggaattggcatgtttatctacaactggttcccgacggtttttgctgatgtgctcagcaacctgaattggctaacctggattaagccaaataacttcaatctcgctgccattactgggggcaggtacggtattgctacaaacccattgcctaccttagattggaattatatcacacattgggcattggcgttaccattttatactgttttcttgcaatatctcgggtccttactttctgttgtgattataatagcagtttactacactaactacatggaatgtcagtatttgccgatatttggtcaaccattgtatagtaacgaaggaaagtttttcgacgccagtaaagtgcttactgattttaaattagactggcaaaaataccaacagtattcactgccatactattcagctggaaatattgttggatatggctcgtttatttctctatacacgctccttgctgcatacagtattatcacagagtatgaaattctaggtggcgcttgcaaacgattgggggttggattgtggtctctaacgaagttagatacttggaggaatcttcacaaaaatgactcctctatccttgagggttacgacgatgcacactgccgcgaaatgcgcaagtacccggaagttcccgaatggtggttctttgctatcttccttatatctctggtattggcgattatattggttactacatacaagaccaatacacctgtgtggggcatcttcttggctgttggtctcaatgttgcattcttattaccactaacaactcttcaatcaacgacaggtgcaagtctcggtctcaatttgctcgtgcagatgataacaggttacttgcttcccggaaacccttacgccctcatgatcatcaaagcttttggttataacatcgatggccaagccgacaactacttatcaaatctgaaaatggctcactattgcaaaatacctccagtgcctctattccgcggtcaattgtccatggtgctgctgcaggtcattgtcagtcttgctgttattaattggcagattcataatgtccctgatttctgtaatccaaaaaacagaagcggctttatttgccaaggccccaggacatactacaatgcgtctattgtatggggaataattgggccaaagaaggtgttcagctacttatacccgatgatgaaatggtgttggctaattggtgcactgttaggagtgcttttcggaggctggtgccgcttgtctaggaaatacaaactctattatccacgcagcttcaatccggtggtctttgtgacaggtatgatttcattgatgcctccgtataacctaagagtttacacatccaagctttatgtggcctttattggccagtattggctcagaaggtatcatctgcgaatttgggaaaaatacaactatgtggttgctgcagccttcaactgtggagttatattttcagctatcacgatattctttgcgatacaatatccagaaataagattagactggattctcaatacgattaacgatgttggtatcgatgcaacccctacacctctaaaagatgtcaaacttaccgaaagaggttattttggcccaccccgggggagccttccttag

SEQ ID NO: 34 - protein, 877 aa, Ashbya gossypii
MDFQQVDTKEKNSDRLPSPCAPASEKDGKAGSQDVPLSDTQELSLLDDEHLILLLHKMGYKHADLEDIPPVVHYLVARINELTIEKSLTILKKCAVDHAGDPNITEEEATDLERFTSGDFDHTDETEVFQLKLLAALFYYHSPYPEVRAVVGPGDDPTIPVETFRCYFLTTTITIIGCGLTTFFQSRYPLIEFSSMAAQFLFFILGTLWSKFMPAVRIPIFPGYGFQLNLQTSWSKKEQMFATLLYSITTGVFYSYFNILTQDMFYNDPTSLGFQIILSLSLQFMGFGLAGLLRPFVVFPARALWPLSMPTIALNNALLAQDVGKGTSIRKVFFYFGIGMFIYNWFPTVFADVLSNLNWLTWIKPNNFNLAAITGGRYGIATNPLPTLDWNYITHWALALPFYTVFLQYLGSLLSVVIIIAVYYTNYMECQYLPIFGQPLYSNEGKFFDASKVLTDFKLDWQKYQQYSLPYYSAGNIVGYGSFISLYTLLAAYSIITEYEILGGACKRLGVGLWSLTKLDTWRNLHKNDSSILEGYDDAHCREMRKYPEVPEWWFFAIFLISLVLAIILVTTYKTNTPVWGIFLAVGLNVAFLLPLTTLQSTTGASLGLNLLVQMITGYLLPGNPYALMIIKAFGYNIDGQADNYLSNLKMAHYCKIPPVPLFRGQLSMVLLQVIVSLAVINWQIHNVPDFCNPKNRSGFICQGPRTYYNASIVWGIIGPKKVFSYLYPMMKWCWLIGALLGVLFGGWCRLSRKYKLYYPRSFNPVVFVTGMISLMPPYNLRVYTSKLYVAFIGQYWLRRYHLRIWEKYNYVVAAAFNCGVIFSAITIFFAIQYPEIRLDWILNTINDVGIDATPTPLKDVKLTERGYFGPPRGSLP

SEQ ID NO: 35 - DNA, 2658 bp, Ashbya gossypii
  CDS (1)..(2658)
atggagaagttgtcgggagaatttaaagggtctcctccgtacttcaatgaagacaaggatagcagctcgctatcaccaagtttacctagtcaagacgataaaaagtacaaatacaatgtttctgcagacgcacaagagaccaaagaggtcctgactgaggatcaattgatatatatcactactcgaatgggctatgaacacgctacagatctcgagcatatccctgaatcagtaagatacctagagtccaagcttgcggacttggatgtcgaaaagtgctgtgaaattattgatgtacatatcaaggagcacgatcaggacccaaatttaagtactgaggattggaatgatctagttcgtttctctaagagagattttgaccccaaaaatccgcagcaggtgtttgaacttaaagttgttgcagctatctttcattattattcgccatacgtggaagtgagggcggtcgcaagccctgtggatgatccgaccattccagtagagactttccgtgcttatttcttggcgactctttgggtggttatcggtagtggtttcaacatgttttttgcgcagaggcagccagcaatcagtcttggagtatttgccgtgcaaatgctggtatatccatgtgcagttttgtgggtgcgcgtgatgccatgctggggtttcaaagtctttggtcgcagaattgcgctcaacattgagtctcagtggagtgagaaggagcagatgtttgtgacactgctgtacagtatcaccaatggcgcattctactctgaatataatattgtaacacagcaaattcactacaaaagccctatgtcatatgcatatcaatttctactatcattttcacttcagttcttggggtttggattagctggaatcatgagaagatatgtcgtgtatccatcaattgccctttggccatccagtatgactactatagccctaaacaaggcactactaagctccgaccactcgaatggtattggtagaaaaaaaatgttttacattactgcgacggccatatttgtatacaattggtttccgacataccttttcgaagccttgagtacctttaactggatgacttggataaagccagataacttcagtcttgcaactgtcaccggtgggattaatggcgtgggactgaacccaatttcgactttcgattggacgaacattggaacgagcagcctttacctcccgttcagagtaacactgactacgtatttgggaggcctacttgcagcactagtcactcttggcgtctattatatgaattacagagaatgccagtttcttccaatattcacgcaaagcttatataataacagagcaacatcgtaccgggtagaagaaatactgactgaagatcgaaagctcgacgagcagaagttccagaaatatggatttccatactatactgcaggtaacattgtggcatatgggtgttttatgtgcgtttacaccgctcttgtagtgacatccattctgcagcagggggcattttatggacgggtgtataaaacttggatcctagatttatggtcgctgagaaagccgagctcatggcgtgcagtgttcagtaatgataagcacgtgctagacgatttccacgattcacacagtcggatgatgaggaaatacaaagaggtacctgaatggtggtacatgactatattcatagtttcaattgtaattggaatcattgtggtgaaagtattcaaaacaaatacacctgtgtggggattatttctagcagtagctttaaattttgttctgttacttccaatcacgttactacaagcgacgcgcggtgttactataggactgaacctgttgctgcagatgataagtggcctggcactaccgggaaatccctatgctctaatgtttatcaaggcctttgggtataatattgatggccaagctgataactatcttggcaatatgaagttggcacattacgcaaagataccacccgttccactatttcggggacagcttttaatggttctgatacagatctttgtgaatcttggcgttatcaattggcaacttcataatattgagaactattgcgatcctaagcagcggttcaagtttacgtgtccgggaattagaacatacttcaatgcttctgttatgtggggtgctattgggccaaagagaatttttgaacatgtctatcctatcatgaaatggtgctggttaattggggcgtgcgtaggattgttcttcggactatggaaaaagctcagtatcatgtacaaaaagataccctaccctgaccggtttagtccggtaatatttatcattggaatgctttcttttggtcctccctacaatttgcagtatactacctctggtctctatgtgggcttcatttctatgtgttacatgaaaagataccaccttcgcgtatgggaaagatataactatgtcgttgctgctggtatctcctgtggtttagtgttttctgctatcgtgatgttcttcaccgttcaatggaagggtgtcgaaatatcatggtgggggaatacggtttcatatgcgggtcttgattacgctcgggtaccgcttctcaatgtgactgaaacagagagaggatactttggaccagaacttggccaaattcctgggtag

SEQ ID NO: 36 - protein, 885 aa, Ashbya gossypii
MEKLSGEFKGSPPYFNEDKDSSSLSPSLPSQDDKKYKYNVSADAQETKEVLTEDQLIYITTRMGYEHATDLEHIPESVRYLESKLADLDVEKCCEIIDVHIKEHDQDPNLSTEDWNDLVRFSKRDFDPKNPQQVFELKVVAAIFHYYSPYVEVRAVASPVDDPTIPVETFRAYFLATLWVVIGSGFNMFFAQRQPAISLGVFAVQMLVYPCAVLWVRVMPCWGFKVFGRRIALNIESQWSEKEQMFVTLLYSITNGAFYSEYNIVTQQIHYKSPMSYAYQFLLSFSLQFLGFGLAGIMRRYVVYPSIALWPSSMTTIALNKALLSSDHSNGIGRKKMFYITATAIFVYNWFPTYLFEALSTFNWMTWIKPDNFSLATVTGGINGVGLNPISTFDWTNIGTSSLYLPFRVTLTTYLGGLLAALVTLGVYYMNYRECQFLPIFTQSLYNNRATSYRVEEILTEDRKLDEQKFQKYGFPYYTAGNIVAYGCFMCVYTALVVTSILQQGAFYGRVYKTWILDLWSLRKPSSWRAVFSNDKHVLDDFHDSHSRMMRKYKEVPEWWYMTIFIVSIVIGIIVVKVFKTNTPVWGLFLAVALNFVLLLPITLLQATRGVTIGLNLLLQMISGLALPGNPYALMFIKAFGYNIDGQADNYLGNMKLAHYAKIPPVPLFRGQLLMVLIQIFVNLGVINWQLHNIENYCDPKQRFKFTCPGIRTYFNASVMWGAIGPKRIFEHVYPIMKWCWLIGACVGLFFGLWKKLSIMYKKIPYPDRFSPVIFIIGMLSFGPPYNLQYTTSGLYVGFISMCYMKRYHLRVWERYNYVVAAGISCGLVFSAIVMFFTVQWKGVEISWWGNTVSYAGLDYARVPLLNVTETERGYFGPELGQIPG

SEQ ID NO: 37 - DNA, 2673 bp, Ashbya gossypii
  CDS (1)..(2673)
atgagcaagatctctgaaggtgtcggggaccccccttcgtatggtagccgctcaccaagcttatctagtcacgacaaggaaaaggaaaaatacaatgctggtgcagaagagcaagttaccgcggaggttctcacagacgagcaattggtgtacctcatctctcgaatgggctacgaccaccccagagatctcagcgatgtgcctgcttcagtaagatacctggagtcgaagcttgcggaattggatatcgagaaatgcttgagaataatcgatctgagctttgagatacataatgaggacttcaatttaaagactgatgattggaatgatttagttcgtttctcgaagagagattttgaccccgaagatccgcagcatgtgttcgaacttaaaactgttgcagggattttcgagtactactcgccgtacgtggaagtgagggcggtcgcgagccctgtggatgatccaacgattccagtagagactttccgtgcctatttcttggcgactttttgggtggttgttgggagtgccttgaccatgttcttttcggagagacagccttcaatcgctctcagtatatctgcggtgcagatgctggtgtatccctgtggactcctgtgggcgcgcttgatgccatgctggggcttcaacgtctatggccgcaggattgcactcaacatcgatagtccgtggaccgagaaggagcagatgtttgtgacgctgttgtacggtatcactactggctcgttctacgcgaactataatattttaacgcagcacattcactacagaagccctatgccatatgcgtatcaattgctactatcaattccactccagttcttggggtttggcttggctggaatcatgagaaaatacgtggtgtatccagcgactgctatgtggccatccataatgactacgatagcgctgaataaggcgatgatgagcgacgagcactcgggggggtttggtagaaaaaagatgttctacttgacttttgcaattattttcgtatacaattggtttccgacataccttttcgaagccttgagtacttttaactggataacttggataaaaccggataacttcaatcttgcgactgtcactggcggaattaatggcgtgggactgaacccactttcgacgttggactggactaacattggagtgggcggtttttatcttccattcagagtaacgctgactatgtatatgggaggtctacttgcagcactaatcactctcggcgtctattatatgaactacagtgaatgtcagtttcttccaattttcacgcaaagcttatataataacaaagcaaaagtgtaccaagtagaggaaatactgactgaagatcgattactcgatgagcagaagttccagaaatacggatttccatattatactgcaggtaacatggtggcgtatggttgttttatgtgcgtttacacagcgcttgtggtgagctccatcctgcagcagggggcattttatatgcgggtgtataaagcctggatcctagatctatggtcactgagaacgcgtagcgggttgcgtgaagccttcagtaacgaaaagcacgtgttagacgaattccacgacccacactgtcggatgatgaggaaatacaaagaagtacctgagtggtggtacatgtcaatatttgtggtttcaatcgtgattggagtcatcgtggtgacaacgttcaaaaccaatacacctgtgtggggattatttctagccgtaggcttaaacttcattctgcttcttccaattacgttactacaagccacgcgcggtgttactataggactgaacctgttgctgcaaatgatcagtggcctggcattgccaggaaatccttatgcgctaatgtttatcaaggcattcgggtataatattgatggccaaactgataactatctcagcaatatgaagatggcacactacgcgaaaataccacctatcccactatttaggggacagcttttaatggttctgatacaggtctttgtgaatcttggcgttataaattggcagcttcataatgttgagaactattgcgatcctaagcagcggttcaagttcacatgtcccggcgtcagaacatacttcaatgcttctgtcatgtggggtgctattggaccaagacgaatctttgaacatgtctatcctatcatgaaatggtgctggttaattggggcgtgcgtaggattattcttcggaatatggaagaggctcagtatcatgtacgacaaaataccgtaccctagacgtttcagtccggtgatcttcattattggcatgctttcttttggtcctccctataatttgcagtatagtacctctggtctctatgtgggcttcatttctatgttttacttgaaaagataccaccttcgtatatgggagaggtataattatgtcattgctgccgccatcacctgcggggtggtgttttctgctatcttgatgtttttctccgttcaatggaaggacattgaacttaactggtggggaaacagtatctcatatgcgggtcttgattacgctcgggtgccgcttcttaatgtgaccgaaactagagaggatactttggaccagagcttggccacattccgaaatagcctaagcgcgaacttttacaaactttccataatatga

SEQ ID NO: 38 - protein, 890 aa, Ashbya gossypii
MSKISEGVGDPPSYGSRSPSLSSHDKEKEKYNAGAEEQVTAEVLTDEQLVYLISRMGYDHPRDLSDVPASVRYLESKLAELDIEKCLRIIDLSFEIHNEDFNLKTDDWNDLVRFSKRDFDPEDPQHVFELKTVAGIFEYYSPYVEVRAVASPVDDPTIPVETFRAYFLATFWVVVGSALTMFFSERQPSIALSISAVQMLVYPCGLLWARLMPCWGFNVYGRRIALNIDSPWTEKEQMFVTLLYGITTGSFYANYNILTQHIHYRSPMPYAYQLLLSIPLQFLGFGLAGIMRKYVVYPATAMWPSIMTTIALNKAMMSDEHSGGFGRKKMFYLTFAIIFVYNWFPTYLFEALSTFNWITWIKPDNFNLATVTGGINGVGLNPLSTLDWTNIGVGGFYLPFRVTLTMYMGGLLAALITLGVYYMNYSECQFLPIFTQSLYNNKAKVYQVEEILTEDRLLDEQKFQKYGFPYYTAGNMVAYGCFMCVYTALVVSSILQQGAFYMRVYKAWILDLWSLRTRSGLREAFSNEKHVLDEFHDPHCRMMRKYKEVPEWWYMSIFVVSIVIGVIVVTTFKTNTPVWGLFLAVGLNFILLLPITLLQATRGVTIGLNLLLQMISGLALPGNPYALMFIKAFGYNIDGQTDNYLSNMKMAHYAKIPPIPLFRGQLLMVLIQVFVNLGVINWQLHNVENYCDPKQRFKFTCPGVRTYFNASVMWGAIGPRRIFEHVYPIMKWCWLIGACVGLFFGIWKRLSIMYDKIPYPRRFSPVIFIIGMLSFGPPYNLQYSTSGLYVGFISMFYLKRYHLRIWERYNYVIAAAITCGVVFSAILMFFSVQWKDIELNWWGNSISYAGLDYARVPLLNVTETREDTLDQSLATFRNSLSANFYKLSII

SEQ ID NO: 39 - DNA, 2391 bp, Ashbya gossypii
  CDS (1)..(2391)
atggctgatttgagcggcactgcagtaaagcgggagcctgagaaaggccccgcgtcagcgcttgatacgacaggggatcttcctcatatatatgatacagtgagtgtggagacgcctggaccattcgaaactagtgaaaaaaaggtagataaagagggggcagatacagagggagatagcggtgagttcactgatgtgctggtggaggacgattcgccgtaccctgaggtgcgggccgccgtgccgtcgtttgatgacaccaccatgctccagaacacggtacgaatgtggacgataggtttgctgatgactacgataggttccgccgtcaatatgttgttctcgatgcacgcgccctcgatggcagtgagtacttttgtgacgtccatgttggcctggcccctaggccggttctgggcccgctgggttccgaatgtgcgtatctttgggcggtttggagggccattcttgaatcctgggccatttagcttaaaggagcacgcacttatcacagtcatggggaacatttccttcggcggtggtgccgcgtatgcgacggatattttactttcaatgaacatgttctataagagggactatggctggttgttcgatttgctggctatctggagcacacaatgtattggattctcgttagctgggctctgttacaaaattttgatcactcctcctttgatgatttggccctcaacgctcgttcagtgcaccttcttgtccaatatacatattcacaacaacaaggtagcaaatggctggaaagttagcagactgaagtttttcatgattatattcatcgctggattcatatattattggttaccgggctaccttttccaagcgctttcttcattcgcctgggttacttggatagcacccaagaacgtcgtcgttaaccaaatttttggttcatctactggtctaggtttgctcccaatcacgtttgactggaatcaaattgcagggtatgttggctcgccgctagtaccgcctatctcagcgattttcactatcttatgttctatggtgacaatattctggatcgtcgtgccaatcgttcattatagtaatacgtggtatggtaactacgtcccgatcagcgattcaacttctatggatcggttccaacagcggtacaatgtcactaaggtagttaaccaaaggctatctctagatcttgaagcctatcattcctattcccgattgtatttacctaccacgtttgcaatatcctatggtatgtcgtttgcctctgtcatggcaaccatctctcacactgcctgttttcactggagaaccatatacaatggtgtgcgtaatataaatacgcaggaccgagatgtccacgcaaggctaatggaaagatacaaggctccgccttattggtggtatctagtaaccttttttgttttcttggcgttgtctatcgcaactgtacgggcttgggatactcaattgccggtttgggccctattcttagcgctagccattgcaggtttctttctattgccagtgggtattatctacgcgttgacaaacatggcagtcggcttgaacgttatcacggagttcatcattggttacatgctaccaggcagaccgatagcgatgatgttcttcaaaacttttggatatatcaccaacagccaggccatcacatttgcacaggacatgaagttgggccactacttaaaggtcgctcccaaactcatgtttaccgcgcaattcattgccaccatatggggcagtaccgtgcagatagccgttttgagatggtcagaggcaaacataaagggcctctgtaccaaagcgcagcccggccactttacatgccctggtgccaccgttttcttcactgcatctatcatctggggtgtcatcggtccgcagcgcatgttctctgccggtcaaatgtacagttccttaaactactttttcgtgcttggctttttcctccctatcgtgaactggctcattttgagcaagtggtccaagcgcttcgagaagtcgggtaggggactaaagtttgtcgccaaatatttgtcctggcctgtcttctttagtggcactggactaataccccccgctacaccatacaattacggttcatactgtatagtcgggattttcttcggctacttcattaagcggtactacttccagtggtggtgtaagtacaactacagtttgagtgccgcgcttgacatcggtttagcttggggcgctctaatcatctttttctcgacaggaatagcggttaggaaggcgcctgtgtggtggggtaacaccgtcattgatacgcttgatacaaatggtcaggcgattaaatatatactccaggaaggggaatactttgaccgagcatctccatga

SEQ ID NO: 40 - protein, 796 aa, Ashbya gossypii
MADLSGTAVKREPEKGPASALDTTGDLPHIYDTVSVETPGPFETSEKKVDKEGADTEGDSGEFTDVLVEDDSPYPEVRAAVPSFDDTTMLQNTVRMWTIGLLMTTIGSAVNMLFSMHAPSMAVSTFVTSMLAWPLGRFWARWVPNVRIFGRFGGPFLNPGPFSLKEHALITVMGNISFGGGAAYATDILLSMNMFYKRDYGWLFDLLAIWSTQCIGFSLAGLCYKILITPPLMIWPSTLVQCTFLSNIHIHNNKVANGWKVSRLKFFMIIFIAGFIYYWLPGYLFQALSSFAWVTWIAPKNVVVNQIFGSSTGLGLLPITFDWNQIAGYVGSPLVPPISAIFTILCSMVTIFWIVVPIVHYSNTWYGNYVPISDSTSMDRFQQRYNVTKVVNQRLSLDLEAYHSYSRLYLPTTFAISYGMSFASVMATISHTACFHWRTIYNGVRNINTQDRDVHARLMERYKAPPYWWYLVTFFVFLALSIATVRAWDTQLPVWALFLALAIAGFFLLPVGIIYALTNMAVGLNVITEFIIGYMLPGRPIAMMFFKTFGYITNSQAITFAQDMKLGHYLKVAPKLMFTAQFIATIWGSTVQIAVLRWSEANIKGLCTKAQPGHFTCPGATVFFTASIIWGVIGPQRMFSAGQMYSSLNYFFVLGFFLPIVNWLILSKWSKRFEKSGRGLKFVAKYLSWPVFFSGTGLIPPATPYNYGSYCIVGIFFGYFIKRYYFQWWCKYNYSLSAALDIGLAWGALIIFFSTGIAVRKAPVWWGNTVIDTLDTNGQAIKYILQEGEYFDRASP

SEQ ID NO: 41 - DNA, 2274 bp, Oryza sativa
  CDS (1)..(2274)
atggcgtcgttgaagtcgccggtggcggcggaggagcaggcggcgacggcggcggcggcggcggcgaagggggaaggggagaggtgcccggtggaggaggtggcgctggtggtgccggagaccgacgacccgacgacgccggtgatgacattccgggcgtggacgctggggctcgcgtcctgcgtcgtgctcatcttcctcaacaccttcttcacctaccgcacgcagccgctcaccatctcggggatcctggcccagatcctggtgctccccgcggggcagttcatggccgccgtgctgcccagccgcgaggtgcgcctcctcggcggccgcctcggcagcttcaacctcaacccggggcccttcaacatcaaggagcacgtcatcatcaccatcttcgccaactgcggcgtctcctatggcggcggcgacgcctactccatcggcgccatcaccgtcatgaaggcctactacaagcagtccctcagcttcctctgcgccctcctcatcgtcctcaccacacagatactgggctatggttgggccgggatgctgaggaggtacctggttgacccggctgacatgtggtggccatcgaatttagcccaggtctcactcttcagggcgttgcacgagaaggagggcggcgatggcgggaaggggtcgtcgtcgagggggcctacacggatgcgcttcttcctcatcttcttcttcgcgagcttcgcctactacgcgctgccgggctacctgctccccatcctgaccttcttctcgtgggcgtgctgggcgtggccgcacagcatcacggcgcagcaggtgggctccggctaccacggcctcggcgtcggcgccttcacactggactgggccggcatctcggcgtaccacgggagcccgctggtggcgccgtggtcgtccatcgccaacaccgccgcgggcttcgtcatgttcatctacctcatcgtgccgctctgctactggaagttcgacacgttcgacgcgaggaagttcccaatcttctccaaccagctgttcacggcgtccgggcagaagtacgacaccaccaaggtgctcacgagggagttcgacctcaacgtggcggcgtacgagagctacgggaagctgtacctgagcccgctgttcgccatctccatcgggtccgggttcctgaggttcacggcgacgatcgtgcacgtggcgctgttccacggcggggacatctggaggcagagcaggtcggcgatgagctccgcggcggcgaagatggacgtgcacgcgaagctgatgcggcggtacaagcaggtgccgcagtggtggttcctcgtgctgctcgtcggcagcgtcgccgtgtcgctggtcatgtcgttcgtgtacagggaggaggtgcagctgccgtggtgggggatgctcttcgccttcgccctcgccttcgtcgtcaccctccccatcggcgtcatccaggccaccaccaaccagcaaccggggtacgacatcatcgcgcagttcatgatcgggtacgcgctgccggggaagccgatcgcgaacctgctgttcaagatctacgggaggatcagcacggtgcacgcgctgtcgttcctcgcggacctcaagctggggcactacatgaagatcccgccgcggtgcatgtacacggcgcagctggtgggcacggtggtcgccggcgtggtgaacctggcggtggcgtggtggatgctgggcagcatcgacaacatctgcgacgtggaggcgctgcacccggacagcccgtggacgtgccccaagtaccgggtcacgttcgacgcgtcggtgatctgggggctcatcggccccgcccggctgttcggccgccacggcctgtaccgcaacctggtgtggctgttcctcgccggcgccgtgctgcccgtgccggtgtggctgctcagcagggcgttcccggagaagaagtggatcgcgctcatcaacgtccccgtcatctcctacgggttcgccgggatgccgccggcgacgccgaccaacatcgcgagctggctcgtcacgggcaccatcttcaactacttcgtgttcaagtaccgcaaggggtggtggcagaagtacaactacgtgctgtcggcggcgctcgacgccggcacggccttcatgggggtgctcatcttcttcgccctgcagaacgcccaccatgagctcaagtggtggggcacggcggtcgaccactgcccgctcgcctcctgccccaccgcgccggggatcgccgtcaagggatgcccggtgttctga

SEQ ID NO: 42 - protein, 757 aa, Oryza sativa
MASLKSPVAAEEQAATAAAAAAKGEGERCPVEEVALVVPETDDPTTPVMTFRAWTLGLASCVVLIFLNTFFTYRTQPLTISGILAQILVLPAGQFMAAVLPSREVRLLGGRLGSFNLNPGPFNIKEHVIITIFANCGVSYGGGDAYSIGAITVMKAYYKQSLSFLCALLIVLTTQILGYGWAGMLRRYLVDPADMWWPSNLAQVSLFRALHEKEGGDGGKGSSSRGPTRMRFFLIFFFASFAYYALPGYLLPILTFFSWACWAWPHSITAQQVGSGYHGLGVGAFTLDWAGISAYHGSPLVAPWSSIANTAAGFVMFIYLIVPLCYWKFDTFDARKFPIFSNQLFTASGQKYDTTKVLTREFDLNVAAYESYGKLYLSPLFAISIGSGFLRFTATIVHVALFHGGDIWRQSRSAMSSAAAKMDVHAKLMRRYKQVPQWWFLVLLVGSVAVSLVMSFVYREEVQLPWWGMLFAFALAFVVTLPIGVIQATTNQQPGYDIIAQFMIGYALPGKPIANLLFKIYGRISTVHALSFLADLKLGHYMKIPPRCMYTAQLVGTVVAGVVNLAVAWWMLGSIDNICDVEALHPDSPWTCPKYRVTFDASVIWGLIGPARLFGRHGLYRNLVWLFLAGAVLPVPVWLLSRAFPEKKWIALINVPVISYGFAGMPPATPTNIASWLVTGTIFNYFVFKYRKGWWQKYNYVLSAALDAGTAFMGVLIFFALQNAHHELKWWGTAVDHCPLASCPTAPGIAVKGCPVF

SEQ ID NO: 43 - DNA, 2594 bp, Oryza sativa
  CDS (77)..(2290)
tgccagcaattccgtcactttgacagattattctgaagcgcgaggttttgcaggcgcctcctcgcgcggggtagcaatggagattgagcatctcggcgcccgcgcggccgccgccgccggcgaggatgaccagtcgccggtggagcaggtccggctgaccgtgccgacgaccgacgacccgtctctgccggtatggacgttccggatgtggaccatcgggctcctctcctgcgccatgctctcctacatcaaccagttcttctcctaccgctctgagcccatcgtcatcacccagatcactgtccaggtggcggcgctgccaatagggcacttcttggcacgcgtgctgccgaagaggaagttcacggtgttcgggcgggagtgctcgctgaaccctgggccattcaacgtgaaggagcacgtcctgatatccatcttcgccaacgccggcgccgcgttcggcaacggcggcgcctacgccatcgacatcatcaacatcatcaaggcgttctaccaccgcagcatctcctttcccaccagcctcctcctcgtcatcaccacccaggtgttgggctacggatgggcagggctgatgaggaagtacgtggtggagccggcgcacatgtggtggccgcagagtctcgtgcaggtttccctcctgagggcgttgcacgagaaggagaacctgcggatgacgcgggccaagttcttcctgatcgcgctgatctgcagcgcggcgtggtacgtggtgccgggctacctgttcccgaccgtgggcgcggtgtcgtggctgtgctgggcgttcccgaggtcggtgacgatgcagcagatcgggtccggcatgagcggcctcggcgtcggcgccttcacgctcgactgggccaccgtcgtctccttcctgggcagcccgctcgtgtacccgttcttcgccatcgtcaacgtctgggtcggcttcgtgctcctcgtctacgtcatgctgcccatcgcctactgggtgctcaacctgtaccaggccagcacgttcccctttttctccgcgagcctgttcgaccacaccggcgaggagtacaggatctcggagatcgtcaacgacaggttcgagctcgacacggacgcctacgcgcggcaggggaagatccacctcagcctcttcttcgccacctcctacggcctcggcttcgccaccatcgccgccaccctgtcccacgtcacgctcttctatggaacggagatgtatcgcaggttccggcaggcggccagggagaacccggacgtgcacacgaggctgatgaggaggtacgatgacatccccaactggtggttctacggcatgctcgcgttggccatggtggcggcgctgttgctctgcaccgtgttcaaggacgaggtgcagctgccgtggtgggcgctactctgcgccgtggccgtggccgccttcttcacgctccccatcagtgttatcaccgccaccacaaacacgaccccagggttgaacatcatcacggagtatgtgatggggctgatcatgccggggaagccgatagccaacgtgtgcttcaaggtgtatggttacatcagcatgaaccaggccgtctccttcctcactgacttcaaactcggccactacatgaagattcctccaagatccatgtttctagtccagttcatcgggacgatcgtggcggggacggtgaacatgtcggtggcgtggtggctgctgtcgacggtgccgcacatctgcgacaagaagcacctcccggaggggagcccgtggacgtgcccgggctcccgcgtgttcttcgacgcgtcggtgatctggggactggtcgggcctcgccggatcttcggcccgctcggctactacggcgcgctcaactggttcttcctcggcgggctggcagggccggcggtggtgtggctgctggcgagggcgctgccgcggcacgccggctggatcaggctcatccacctccccgtgctcctcggcgccaccgccaacatgccgccggcgtcgacgctcaactacacggcgtggtgctccgtcggcgccgtgttcaactacctggtgttccgccgccgcaaggcgtggtggcagcggtacaactacgtgctgtcggcggcgatggacgccggcgtggccatcatgggcgtgctcatctacttctgcctgtccagccgcggcatcaccccagactggtggggcaacagcgacatcaacatcgaccactgcgacctctccacctgccccaccgccaagggcgtcattgtggagggatgtcccgtcttctgatcgatcatccatccaatatacatatttcccccgtagatgtgttcttcgtgcgaaactagatcagtaaaatcaatcagaatctgaatctctactcgtttaatatggcaggactgatgctgttcttatttaaagttgtatatatcatttgggtttttaggtttccaaatgctcttctttttcgtgttttaaccaagttcagtgagctcagttacccagttagtatattatagaattggtttcgctccaatggagttttattgctgtgttttaattgagttcaatgagatatatattggttaagtcc

SEQ ID NO: 44 - protein, 737 aa, Oryza sativa
MEIEHLGARAAAAAGEDDQSPVEQVRLTVPTTDDPSLPVWTFRMWTIGLLSCAMLSYINQFFSYRSEPIVITQITVQVAALPIGHFLARVLPKRKFTVFGRECSLNPGPFNVKEHVLISIFANAGAAFGNGGAYAIDIINIIKAFYHRSISFPTSLLLVITTQVLGYGWAGLMRKYVVEPAHMWWPQSLVQVSLLRALHEKENLRMTRAKFFLIALICSAAWYVVPGYLFPTVGAVSWLCWAFPRSVTMQQIGSGMSGLGVGAFTLDWATVVSFLGSPLVYPFFAIVNVWVGFVLLVYVMLPIAYWVLNLYQASTFPFFSASLFDHTGEEYRISEIVNDRFELDTDAYARQGKIHLSLFFATSYGLGFATIAATLSHVTLFYGTEMYRRFRQAARENPDVHTRLMRRYDDIPNWWFYGMLALAMVAALLLCTVFKDEVQLPWWALLCAVAVAAFFTLPISVITATTNTTPGLNIITEYVMGLIMPGKPIANVCFKVYGYISMNQAVSFLTDFKLGHYMKIPPRSMFLVQFIGTIVAGTVNMSVAWWLLSTVPHICDKKHLPEGSPWTCPGSRVFFDASVIWGLVGPRRIFGPLGYYGALNWFFLGGLAGPAVVWLLARALPRHAGWIRLIHLPVLLGATANMPPASTLNYTAWCSVGAVFNYLVFRRRKAWWQRYNYVLSAAMDAGVAIMGVLIYFCLSSRGITPDWWGNSDINIDHCDLSTCPTAKGVIVEGCPVF

SEQ ID NO: 45 - DNA, 2382 bp, Neurospora crassa
  CDS (1)..(2382)
atggacgagatcgtggaatgcaagcccgcaccagctgctgacctgcgcgaactgaacgagaagtacgacatccaacatgtggcaccaatcgaaaccaagaccgctgccatagcgaaagatgggagcgttgatgctgagtctgctgatatcacaacagacactaccgtcgatacgcctttacagctggtcaccaagaccctcgacacgtccgatgacccgactgagaatatctacaccttccgtgccttcgtccttgggctaggcttgtcggcctttggtgctgttctcggcgagatcttctacttcaagccacaaactgtcaacgtgagcattgtgttcctgatcatgatcgcctactgtcttggcgaggccactgtcttgatccctcgctggggtcctgttggccgttttctcaacccggggccgttcacccagaaggaacacgttttcatcgtcattatggccagctctgccgccacctgtgccctcggaaccgaacaacttgccgcccagtctctatactacggcaatcaaccaaatgcagcgtcggccattttcatgctgttctcctcgcagtgcattggctatggtcttctcggtggcatacgcaaagctttcatctaccccaccaaattcgtctggccatcacagcttccaaatgcagcactattccagtcgatgcacctaaacaaggaactggccaagaaacgactcaaaatcttctggtgcatctgcttggctgtcatggtctgggagattgtgccccaatggatgtttcctctcaccactggaatttccatcttctgcctcgccaaccaggactcggccttcttcacgcgcctgttcggaggagccaatggaaacgagggcatgggcttccttagctggtgcatggactggcagtacattggagaaaaggagtttactctgcccctgagtacattggtcaaccaactcatcggctacattggctgtattgctttgaccttgggcgcttactactccaatctctgggatgcgaagagattcccctttatggcgcaatctttgtttacttccaatgggaccgtctatgaccagacacagatcttgggtccagacaaccaggttgatccagctgctttgcaagcctacgggcttcccaggtttgccaccagcaaagctttgagtttgctgatgaagaacatgggcatcacggcagctgtggtacatgtcattctctggaactggcatgacataaaattcatatttggtccttttcggccttcgacttggaagcaaaacgtccagaaagccagaacgtggtggcaccatgggttcagctcatccttctggaagaacttcacctctgacgcagacacccctcgcaaagaataccccggtaccgaaggggacccccattacgccgctatgcgtgcctacaaggaggtgccatcattgtggtatctcagcatcctcgccatctcaatcatgattggcctgatctgctgttaccagcaaaagactggcctcccttggtgggcgttcctacttgccgtcctgctggcctggatcttgaccattttctttgcgtgcatgtatggcattgttgggttctactatcaaccaacaagcgcggttcagatgatcggtgcttacatggttcctcgcagaccggtagcgaacatgatgttcaccctctatggatccaatgccctggtgcaagccatccagatgttgggcgatctcaagttggcacaatatgcgaagctcccacccagagcaacctttcttgcgcagattcttggaacatgtgctggctcagtgttcaactgggtcatgatgaacagcattgtggataatcggcgcgacattctgttgtccgttcagggcaccaacgtctggtctggtcagaatgtacagacttacaattcccaggcggtcgcttggggcggtacggccaatgagatcttgtaccacagcggacgtcatggaacgtactggatggttccaatggggctgttcttcggaatctttgccccattgccattttggatcggtcacaagtacttccctcaactcagactcaaccatatcaacacatttctcatctgcacttggctgggctggttgtctgtcggtatcaactcttcgcttttggcatactttgtgtttggcttcttttcccagggctatcttcgtcgatacaagccggcgctgtttgccaagtggaacaatatctgtgcggcagccatagccggtggttgttccttgatcatcttcatcctcacctttgccgtggcgggcggcagtggcaaggccagagacttcccgaaatggtggggaaacaacatggatggtaacgtggacaggtgcaagtacatgtacctgaatggaaaatga

SEQ ID NO: 46 - protein, 793 aa, Neurospora crassa
MDEIVECKPAPAADLRELNEKYDIQHVAPIETKTAAIAKDGSVDAESADITTDTTVDTPLQLVTKTLDTSDDPTENIYTFRAFVLGLGLSAFGAVLGEIFYFKPQTVNVSIVFLIMIAYCLGEATVLIPRWGPVGRFLNPGPFTQKEHVFIVIMASSAATCALGTEQLAAQSLYYGNQPNAASAIFMLFSSQCIGYGLLGGIRKAFIYPTKFVWPSQLPNAALFQSMHLNKELAKKRLKIFWCICLAVMVWEIVPQWMFPLTTGISIFCLANQDSAFFTRLFGGANGNEGMGFLSWCMDWQYIGEKEFTLPLSTLVNQLIGYIGCIALTLGAYYSNLWDAKRFPFMAQSLFTSNGTVYDQTQILGPDNQVDPAALQAYGLPRFATSKALSLLMKNMGITAAVVHVILWNWHDIKFIFGPFRPSTWKQNVQKARTWWHHGFSSSFWKNFTSDADTPRKEYPGTEGDPHYAAMRAYKEVPSLWYLSILAISIMIGLICCYQQKTGLPWWAFLLAVLLAWILTIFFACMYGIVGFYYQPTSAVQMIGAYMVPRRPVANMMFTLYGSNALVQAIQMLGDLKLAQYAKLPPRATFLAQILGTCAGSVFNWVMMNSIVDNRRDILLSVQGTNVWSGQNVQTYNSQAVAWGGTANEILYHSGRHGTYWMVPMGLFFGIFAPLPFWIGHKYFPQLRLNHINTFLICTWLGWLSVGINSSLLAYFVFGFFSQGYLRRYKPALFAKWNNICAAAIAGGCSLIIFILTFAVAGGSGKARDFPKWWGNNMDGNVDRCKYMYLNGK

SEQ ID NO: 47 - DNA, 2349 bp, Neurospora crassa
  CDS (1)..(2349)
atggctcacaacaacagcgaaatcgacgacaagacatcatcatggccacctgaaaaggtcgccgccgacttccatggtatcgacgagaagcaccccgacggtcagggcagcgtcgatcccgagtcgctggagggagagaccggcccgctggagacggccgaggatatcgtcacccacgtcattgccgtcgacgatgacccgtccttgagcccatggacctttcgcatgttctttgtcggtgtgggcctttcagtcttcggcggtgtcttgcaggaaatcatgtacttcaagccccaggtcgtttatgtgtccgtcatgttcttgaccgtcctcgcccaggctttgggtacagcgctgtctcagcttatcccgagaaaaggtgccatcggccgcttcctcaacccgtttccctggaaccgcaaggagcacacggctgccgtcctcatggcctcggcggcttcggtatcggccctttccaccgaagccctgtcggtgcaggagctgtggtacggcggctaccccagtaccgcagccggcgtcttcatcaccctgtcctctcagctcatcggctacggtgccgctggcatgatgcgctctgttctgctgtacccgaccaagatgttgtaccctgccaacctgcccatcaccaccgtcatggagaccctgcacaagcccaaggccgagacggccaagcgcttcaaggtcttttggatcatcttcgtcgccatcttctgctgggagtggttccccgagtacatcttccccatcctgtccgccgtgtccatcttctgcttagccgaccagaacaatgccgtcttcaccaacctctttggcggttcgcagggtaacgagggcatgggctttctcaacatctgtttcgattggaactacatcgccggcttcggctccccgctgtggatgcccctgcagactctcaccaacagcttcatcggctacctcggcggcatcatcctgtccatgggtctctactacagcaacatctggcgaggcatggacttccccttcatgtcccagcttctgtacgacggcagctctaactcgaccaactacgtggtctataacgagaccctcatcatgaactcggacttcaccattgacactgacgccgtcgataaggttggcgtcccgtacctgactgccacgtacgtcaactacctcatcaccaccaacgccagtctcaccgccaccctgatccacatgctcctttggaactacgacgacgtcagcaaggcctggagctggatcactctcgacaagctcaagtcgctgcttaagccatccacgtacttcttctggaagtccaccggggcccggactgaagtcgagaaggaggcgattcgccaggacccaaccatcgacccccattaccgtctaatggtcgactacgacgaggtgcccagcagctggtactttgtcgtctttgttatcagcattatcgtcggtatcgtctgcctctacgtcatgaagtcgactttgccgtggtggggattcatcatcggcaccctcctcctgatcgtgctcatcatcttcttcggtgcccagtccgccatcacgggctttaccgtcaacatgcagccagtcatgcaaatgctagcgggctacatgtttcccggcaagccattagcaaacatgtacttcacaacctacacctacaacggtctttcccaaggcatcctcctccttcgcgacctcaaactcgcccagcaaaacaaactctccccccgcgccaccttcaccacgcaaatggtcgggtgcgtcatcggcgcccttctcaactacgtaatgatgatcagcatcgtcaagaaccaggctcccctcctcaagtccgccgagggaagcaacgtctggtccggcgcccaagtccagcaattcaacacgctcgccatcgcctgggccatcgcccccaaaatgttctccatcggcgcccgctaccagtgggtcacggccgcctacctcgttggcttccttgcccctttgcccttttatatcatgcaccgcttcgtcttcccccgccagcgcatctggtcgtatctcaacacgtccatcatcctgtggtacctaggcgaactgtttgtcggtcttaatgcgtcgattacaagttattatatcttgggtgcctttggacagttttacctccgtcggtataggccgcagtggttcgtcaagtggaattacttggtttcggctgcgctggatggtgggacccaggtcatgattttcattgcgacgtttgctgtctttggtgggtcgggcaaggcggtgccgtttcccgagtgggcggggaatcatccgaataacttggattattgcaagtataactctagttag

SEQ ID NO: 48 - protein, 782 aa, Neurospora crassa
MAHNNSEIDDKTSSWPPEKVAADFHGIDEKHPDGQGSVDPESLEGETGPLETAEDIVTHVIAVDDDPSLSPWTFRMFFVGVGLSVFGGVLQEIMYFKPQVVYVSVMFLTVLAQALGTALSQLIPRKGAIGRFLNPFPWNRKEHTAAVLMASAASVSALSTEALSVQELWYGGYPSTAAGVFITLSSQLIGYGAAGMMRSVLLYPTKMLYPANLPITTVMETLHKPKAETAKRFKVFWIIFVAIFCWEWFPEYIFPILSAVSIFCLADQNNAVFTNLFGGSQGNEGMGFLNICFDWNYIAGFGSPLWMPLQTLTNSFIGYLGGIILSMGLYYSNIWRGMDFPFMSQLLYDGSSNSTNYVVYNETLIMNSDFTIDTDAVDKVGVPYLTATYVNYLITTNASLTATLIHMLLWNYDDVSKAWSWITLDKLKSLLKPSTYFFWKSTGARTEVEKEAIRQDPTIDPHYRLMVDYDEVPSSWYFVVFVISIIVGIVCLYVMKSTLPWWGFIIGTLLLIVLIIFFGAQSAITGFTVNMQPVMQMLAGYMFPGKPLANMYFTTYTYNGLSQGILLLRDLKLAQQNKLSPRATFTTQMVGCVIGALLNYVMMISIVKNQAPLLKSAEGSNVWSGAQVQQFNTLAIAWAIAPKMFSIGARYQWVTAAYLVGFLAPLPFYIMHRFVFPRQRIWSYLNTSIILWYLGELFVGLNASITSYYILGAFGQFYLRRYRPQWFVKWNYLVSAALDGGTQVMIFIATFAVFGGSGKAVPFPEWAGNHPNNLDYCKYNSS

SEQ ID NO: 49 - DNA, 4473 bp, Neurospora crassa
  CDS (1)..(4473)
atgaatgggcagattaagtggaaggagaacggaaacggaatcggtacctgtgagtgtagaagcaagaggaacaccccttttgtgattgagtgtcaatgccctgatgacaggggcaacaagagaatatcaagcgtcaacctcaatgagcaactcagatacgaaaacggcaccttcaaatgctttggcgcatcgggaaaaactgaggatgtgtcttatcgattacctggtacatcgggacaaggtggggatatatttgggatcgtggtgcgtgttgtggtttcgcgcaagacagttcgacacggctcactttggctaggaaaggctgttgttagactgtatccgtctcgaactttggacgaggattcgctttcggagcccgattacgttctggattacattggctggcatttctctagaccccttgggattatctttgaatgcgacagcagcccaggtaggagcgccagttccaccgcgatggctcccaaccccccctacatgtcctcgctcttcgagccaacttccgcaccccccgagcccgggcatccgcaattccagcaatcacaacctcaacaccccggcatttcacaacagcagcaacaacaacaagctgctcagcctcagcaaagtcaaccgcggcagaagcagccacgcaaaccccgccagccaagaaaacaaactcaacagcaacagcaacaacagcaacaacaacaacaacaacaacaacagcagcaacaacaacaacaacagcagcaggtccaacaacaacaacagcaacaacaacaacaggtggccgctcagcagcaacccctggtttcaattgacgcccaacggtttgctcaacttcaagccgaggttggtcaacttcaccagctggtccaaggtatcatccatcgtctcgatgcctacggtgtcccatccctgcctggcggacatcatgcaccccttcttcttccgcaacagcacgccccagtctcggctgctgcgacttccaccctagtggccacatctgcaaacgcgggaaccaacaacatcaacttcaatgcgcttctcacagccggtcaatcccatgatggcggcggcagcggtggtggtgtcggtggtggtgaaagtagcgtaagcggcctcgtcaacggcgaccatggtcatcatcacgatgacggctccgctgccaacgtcggcatcacccaccaccaagacgccggcggcggcggcggcggcatggaccacgacgtggatgacgatgacgacgacgaagagtcgcgccaactccagctcctctcggcaaacctagtaggcgaccagtccctcccctccgtctcctggggggtcggggacaacaataacaacggcggttccggaccaggcgcagcaggagcagcagggttcgacatggcctacccacctcaggggcacatcttccacatccaactctccacctcggcgggtggcaagaactacgtcggcggcggtcccaacggggcctcagtcgtggtgaacaattggacgcgccagcacggataccgcgttattactcgtcggtccaagatcaagaatgaccggtatcacttaaccatgtcatgtgcgctcagcggaaacaagtaccgacctgttccgggcccgacgcaggagcagattgaggaggcgagacgcaacgggcagaggaagccgtaccagagaagaatcgggacggataagtgtaattgtccgtttagggcggaggatgtggtttttgcgaagccgctgaagggtgttgggtttgttgggcctgctgggaaagagctgacgagaagtgtggccgtggcgaaccagcagacaaatcccccaagcccaaccgttgagatcgccgaggatgtcgacggcggcactacccaacgacgcgtgtcgagtcatgacccagaaaagatccagtcgagcgccggcacaacccacaagttcagcgaacagatcccacatgagatgctcgaagaactggctcccaacggggagagcgactacatctgcgaaaaggtcgacaacatgagcgaggatgaggccatcgccatcgttcaggaatccgtgaggttccatgccgacgactggaacttcccctcggaaatgcgagagcgtatgaagcgcctgctcgaaggccccaaagcgtatggggagttttacgaccgggacctgcgaatcgatgccactctgatgcgctactcgtctccttatcccggggtttgcgcggtccaagagttgaaagatgacccgactgtgccgattgagactatcagggcatacttcctaggcgtggcgtgggcggtcattggaaccttcatgtcgaccttttttaacagcagatttccgtctataggtcttagtgggtcggtcatccagatcttgttatttccatgtgccaagttcctggaatgggtgctccccgattggggcataacggtctggggtgttcgtcactcgctcaacccgggaccgtggacgttcaaggagcagatgttttccacgatttgctacaatattgccatctacaccaccaactcatatggaatgattttggtgcaaaggctggacggctactacgggctgaaatttgtcaactttggataccaactgatgttaacgctttttgtccaactcatgggcatgggatttgccggatatctacggaggttcagtgtttacccggtcaaggcgctatggccgacaatccttcccacaatcgccatgaaccgagctctgacaagacccgaaccgaaagaaaacatttacggatggaccatttcccgttaccgcttcttttatatatgtaccctgactatggctatatactactggtttccaggctatctgttcactgcgctttcaacgttcaactggatgacatggatagccccagattccgttgtcctctcccttttgaccggctcaatcacaggtttgggattgttcaaccccatcactacgtttgactggaacgttgccacgagctcgtatgccgcactatcccagcctttcttcgccacttgcaccatgtactttggtggtattctcggcggtctcatcattctgggcatatactacaagaacatgaactatacagcttttctgcccatcaactccagctcagcctttgccaacgatgggacgccgtatcaggtccagaaggtggtggtcaacaaccaactggaccaaaccaagtaccagaactattcaccaccattttactcggctggatatatcctgactgttggggcgaacttttgcttctatccagtctactttttctacatcatggtcaaccaatggaagactattggccaagcctatgttgatttctaccatgggttgcgttacggaaagggcaactatgagaacgcaatggatatccacagcagacttatggctcagtaccccgaggttccggattggtggttcctcatcatcctggtgggcgccattgtcgtatccgtcctctttctcaagatttatccgctcgataccccgatctggctcgtgtttctcgtgattgggatcaacctagtgtttgccgtgccgttatcgttcctctcggcaacgactggcacgaacctcggtctgggtgcattgatccaggtgattaccggattcttgctacctggcaataccaacgcctttctgtttgcgcagacactagggtcctgggctctcgcggggtatggtgacaacatggtccaagacctgaagatgggacactatgtgcgaattccgcctagagccgtgtttcgaagtcaaatcgggaccatcatcattaccgtctttgtcgcagtcgggacccaagactttatcatgaccaacgtcaaggggctttgcacccccaaccagccttcccgctttacctgcgccaacgacgggaaccccctctacgccagctctctcatgtggggccttctcgggtcggaccgcatgttcaactccctttacccgctgttcaagtggtgcttcctcatcggaacttgcatcgccctggtcttcctctttggacagacctacggcccccgctacctccccggcgtcaaagaccagctccgccagcgtctctctcgccggatgttctccctgctggaccgcacattgttcccttttgtggcgtccctcctctggctgaaccctatcctcgtcatccagggcgtgcagcactgggcgccgagtaacatgagttacaagacgcccgggttcattttgtcgtacgtgtttatgtactggatgccgaagcaccggttggcgtggtgggaaaagtacaattacgtcttgtcggcggccttgacggctggggtggcggtcagcgggctgattatcttttttgcggtcgggtataatccgaagaagctggagtggtgggggaacacggtgagtggggcgggggtggacgggagagggacgggcgtcttggagattccgaaggatagagggtattttgggccggagaaggggacgtttccttag

SEQ ID NO: 50 - protein, 1490 aa, Neurospora crassa
MNGQIKWKENGNGIGTCECRSKRNTPFVIECQCPDDRGNKRISSVNLNEQLRYENGTFKCFGASGKTEDVSYRLPGTSGQGGDIFGIVVRVVVSRKTVRHGSLWLGKAVVRLYPSRTLDEDSLSEPDYVLDYIGWHFSRPLGIIFECDSSPGRSASSTAMAPNPPYMSSLFEPTSAPPEPGHPQFQQSQPQHPGISQQQQQQQAAQPQQSQPRQKQPRKPRQPRKQTQQQQQQQQQQQQQQQQQQQQQQQQQVQQQQQQQQQQVAAQQQPLVSIDAQRFAQLQAEVGQLHQLVQGIIHRLDAYGVPSLPGGHHAPLLLPQQHAPVSAAATSTLVATSANAGTNNINFNALLTAGQSHDGGGSGGGVGGGESSVSGLVNGDHGHHHDDGSAANVGITHHQDAGGGGGGMDHDVDDDDDDEESRQLQLLSANLVGDQSLPSVSWGVGDNNNNGGSGPGAAGAAGFDMAYPPQGHIFHIQLSTSAGGKNYVGGGPNGASVVVNNWTRQHGYRVITRRSKIKNDRYHLTMSCALSGNKYRPVPGPTQEQIEEARRNGQRKPYQRRIGTDKCNCPFRAEDVVFAKPLKGVGFVGPAGKELTRSVAVANQQTNPPSPTVEIAEDVDGGTTQRRVSSHDPEKIQSSAGTTHKFSEQIPHEMLEELAPNGESDYICEKVDNMSEDEAIAIVQESVRFHADDWNFPSEMRERMKRLLEGPKAYGEFYDRDLRIDATLMRYSSPYPGVCAVQELKDDPTVPIETIRAYFLGVAWAVIGTFMSTFFNSRFPSIGLSGSVIQILLFPCAKFLEWVLPDWGITVWGVRHSLNPGPWTFKEQMFSTICYNIAIYTTNSYGMILVQRLDGYYGLKFVNFGYQLMLTLFVQLMGMGFAGYLRRFSVYPVKALWPTILPTIAMNRALTRPEPKENIYGWTISRYRFFYICTLTMAIYYWFPGYLFTALSTFNWMTWIAPDSVVLSLLTGSITGLGLFNPITTFDWNVATSSYAALSQPFFATCTMYFGGILGGLIILGIYYKNMNYTAFLPINSSSAFANDGTPYQVQKVVVNNQLDQTKYQNYSPPFYSAGYILTVGANFCFYPVYFFYIMVNQWKTIGQAYVDFYHGLRYGKGNYENAMDIHSRLMAQYPEVPDWWFLIILVGAIVVSVLFLKIYPLDTPIWLVFLVIGINLVFAVPLSFLSATTGTNLGLGALIQVITGFLLPGNTNAFLFAQTLGSWALAGYGDNMVQDLKMGHYVRIPPRAVFRSQIGTIIITVFVAVGTQDFIMTNVKGLCTPNQPSRFTCANDGNPLYASSLMWGLLGSDRMFNSLYPLFKWCFLIGTCIALVFLFGQTYGPRYLPGVKDQLRQRLSRRMFSLLDRTLFPFVASLLWLNPILVIQGVQHWAPSNMSYKTPGFILSYVFMYWMPKHRLAWWEKYNYVLSAALTAGVAVSGLIIFFAVGYNPKKLEWWGNTVSGAGVDGRGTGVLEIPKDRGYFGPEKGTFP

SEQ ID NO: 51 - DNA, 4860 bp, Neurospora crassa
  CDS (1)..(4860)
atgcatggctcgacgacagccttcatgctgtttttctccgtgctattaaccctggcatcagtcagagcggcacataatgaggtcgttaccgatgacgcatgcttacagatagcccgttcatatgaaatttggaccaagagtggcggccatggagacttctccgacatcccaggacaaacggcatatgactgtctgatgtccatgccctttgactctgagcgcgcagtcaagtttttgaatgagtacctaaaatatctccagttccagtcgactctcgactctctcaaacatgcgccatctggctacaagacaccctccatcgatcttctcaaaggtttcgacaagattcgacaaagagctgagaaaagtatctacaaaagtcaatacggattcgacaacgacatcaagtcccttatccatcgagcaaacgaaggccatctagaaatcaatctctgctcccagcaaatcttccacttccaacgcagcccttccttggtatccatctcatcagacggcctcgagttacccaaaatctacacatggaacgacgcaaagttgttgtattccggattccccaacacacaagtatcccacctagtcgagatcaactccatcgacgccacttacttcctccaagcccacctcgccctcaccttccaataccacgaccccgacgcccgctacaaccacctcttcccctcccccgtcaaccaatacaccggtcttcttacaggaggcggctggcaaagttaccaaggtctctggccaggagctgcccactacctcctcaaattccacaatggtacgacaatgcaggttaacacaaccgtcacctggcccgctaccaacggacccatgaactacaccgacggccaaacgctcttcaaagccgcttgtctaccagactacacgccctctctttcaagtttctcccactcacccattccaccaccccctcgacagcaccttcacaataatccaaaagacccccctccaagcacagagggaatctaccccacgcccatcatccgcaccccccaaaactcgttaagggggtattacctcgataacgacacagcagtcctacaaatccccaccttccaacacacagccggcatcaccttttcccaaacagcacaagacttcctcacccttgccgcagagcaagacaacaaaaccaagttgattttagatctgagcgggaatcccggaggggacgtgattcccggcttgaatattttcaaggttctgtttcctgacttggaaatccggacggctacaaggtttcgggcgactgagatagtgaaccttgttgggaaggtgtatagtgcggtttataaggatactgagctgagagaagaagaagtgccgattgatcccccgtttatggcgagcgtggctgttagaccggatcagaagactaggtttaccggggggtgggaagagatttttgggccggatgagatacccaaagggggcgggaatatgtcgagattacttgcgcattttgatctagaactggcgtcgacggaggtggatccggtgtttgggtatgggccttttaagaaaagcaagactggacggaggccgtttaaagcggaggatatcgttgttataacaaacggcgaatgcgcatccacctgcgccctcctcatctccctcctccgtcgccaaggcaaagtccgcaccctcgtcttcggcggtcgtccccgacatgcacccatgcaagccgtcggaggcgtcaagggaggacagtattggtctctcaaaaccatttaccgccatgtttcgcgggctgtggagttggctatgtctaagggtacctctacctctacctctacctctacctctactacatgtactatcctgactgaagaggaactgcaaagactgaagaagttggcgcctgctgatcctgatccaaatcctggagctggttttggcaccggcgagttcccgctgaggatgggctggaaaggagagggaggggtgaattttagggatttgtattaccttgatgacgatggagatgaagagaacagtgaggaggaaatggggaaggatttgagtataggcacggttccggcgcagtttatttacgagccagcggattgtaggcggttctttacggtggaaatgatgtttaggccagccaggatgtgggaggtggcgagggaggtcatgtttgggagtggaagcctagtacttcgccggtatctgaggaagaagaagaagaagaagaagaagaagaaaggaggtacttgggggagacgtggacgcctcctctacttccggcgttgggtggccccggtaaggggagggctgcatgaggtggttctggtctgtaaactctacatatcaccgattactcaactacccatcgttggtggacaatcgcatgtatctagcgctggcggcgtggtcgttgcgccaaatttcccctttgataatcgagacgttggcagcagctcgctgcttgcagagaatcttgatgaggaggagaatgatgacttggtcatttatccatccgaacctggatccgagtccgatgccttcatcaaagacaataaccgaaggtcatcctctcttgcctcccctctagagacggaccatggtcgagaggacgccgaggttgggcatcttccaagcgaagatgacgaggtgatcgatcctcgactcaggaactatcccattccccttgtagccaagacagtcgacctacacaacgatgaaaccgaacccctcctaaccatccgcttctggatcctctccaccctctgggtcatcgtcggctgctccgtctcttccgtctactacttcaagccctactccgttcgtctctcgggttacgtcgtgcaactactctcgtgggggatgggcgcactcatggcgcgttacttcccacagaagcaatatactctcacgttacctattcttcgtaaagaaatttcattcaacctcaacccgggcccgtggaaccccaaagaacacgccctcgtcatcgtcgcctactggggcagcacgtacaccgcctacggcctcggcccgctctctgccatggagctctactaccacaagcgcatgagcgggccgtgggccgtcttgtttctcatgaccacgcagctgatggggtacggctttgcgggcgtataccgggacgtcttggtgcgtccgccgggcatgtactaccctggcgtgctacccaacgtgacgctgttcaatgccatgcatcgacacccgtccgtgaccaagaagtcgctggggttttttggggtagtggcggcagcggcgtttgtgtaccagtggttgccggggtttgtgatgcctttgttggcttcgttgccggtggtttgttggatgggattgggaacgaagacggcttttgtgttggggagcggaacgtatgggtttggactgctggacttttcgctggattggaattatgcttcgtttttgaccccgctttatacgccgttgtgggcgacggtgaatcggtttgtgggagccgccgtggtgatttgggtggtgtatcccttggcctacttcttgaatgtcaatggggctcagcagtttgcgccgatgagctcggggacgtgggatgccgaggggaatcggtacaatatctcgcgcatcttgacgccgacgtatgagctgaaccggactgcactggaggagtattctccgccgtattggtctttcagttacgcgatgcacttcttctggggattcgctgcgtcgacggccgtgttgacgtatgctgtcatgtttcatgggcgtcaatcttgggaggcccttcgaagctcgctgcaaaccatcagcaatccctttgcaaagaaggatcacaagcaaaagaagaagaactctcagcaacaccgggccgagtttgacgacccctacctcaagcttaccgcccacctcccccgtgtgccgcactggtggtatctcgccctcctcttttcctgcttggtgattgccattgcccaggtctcgggcggcggcatgcagctcccctggtggggtcttctcctcatcacggccatctccgccctcttcacgttccccagtggcattctctttggcttcaccaatgtgcaaatcggcatggactacctctcggagctgcttgccgggttcctgttccccggcaagcccatcgccgtgctcacgtgcactgtgtacggccggcagatcctcgagcagtgcctcaacctggtcagcgacatcaagttcggcttctacatgaagatccccgagcgcgagctgtttgtggcgcaggtgtatgggacgttgctgggcccgtttgtcaactgggcttgtatgcggctgatcatcgacacgcaggggccgaagctgacgggcgaggtggtgtcggggacgacgtggaacgctttgaagaccaagaacttcttttcgctgtcagttatttggggcgtgctgggtccgcaggtgttctttggggacgagtcgccgtatcgatgggtgtactgggggtttgtcgtgggaccgctggcggtgacgctgctgtggcttgtacaacacagactggcgaggcccaagtgggggaaggtcgcgagcgtggttaatccggtggtgatgctgaacggggcaacgctgtttcccatctatccgacgacgaacctggcgacatcggcgctggtggcggtggtgtttatgggatacgtgtacagataccacccggtgtggttccgcaagtacaattatctgctcggggctgggttagactgtggcgcgcaactggtgcagatggccatgatcttggtggtggacttgcctaatgtgaccatgccgcactggtgggggaatgatgccgtcgccgtggacaagtgttatcccatttga

SEQ ID NO: 52 - protein, 1619 aa, Neurospora crassa
MHGSTTAFMLFFSVLLTLASVRAAHNEVVTDDACLQIARSYEIWTKSGGHGDFSDIPGQTAYDCLMSMPFDSERAVKFLNEYLKYLQFQSTLDSLKHAPSGYKTPSIDLLKGFDKIRQRAEKSIYKSQYGFDNDIKSLIHRANEGHLEINLCSQQIFHFQRSPSLVSISSDGLELPKIYTWNDAKLLYSGFPNTQVSHLVEINSIDATYFLQAHLALTFQYHDPDARYNHLFPSPVNQYTGLLTGGGWQSYQGLWPGAAHYLLKFHNGTTMQVNTTVTWPATNGPMNYTDGQTLFKAACLPDYTPSLSSFSHSPIPPPPRQHLHNNPKDPPPSTEGIYPTPIIRTPQNSLRGYYLDNDTAVLQIPTFQHTAGITFSQTAQDFLTLAAEQDNKTKLILDLSGNPGGDVIPGLNIFKVLFPDLEIRTATRFRATEIVNLVGKVYSAVYKDTELREEEVPIDPPFMASVAVRPDQKTRFTGGWEEIFGPDEIPKGGGNMSRLLAHFDLELASTEVDPVFGYGPFKKSKTGRRPFKAEDIVVITNGECASTCALLISLLRRQGKVRTLVFGGRPRHAPMQAVGGVKGGQYWSLKTIYRHVSRAVELAMSKGTSTSTSTSTSTTCTILTEEELQRLKKLAPADPDPNPGAGFGTGEFPLRMGWKGEGGVNFRDLYYLDDDGDEENSEEEMGKDLSIGTVPAQFIYEPADCRRFFTVEMMFRPARMWEVAREVMFGSGSLVLRRYLRKKKKKKKKKKGGTWGRRGRLLYFRRWVAPVRGGLHEVVLVCKLYISPITQLPIVGGQSHVSSAGGVVVAPNFPFDNRDVGSSSLLAENLDEEENDDLVIYPSEPGSESDAFIKDNNRRSSSLASPLETDHGREDAEVGHLPSEDDEVIDPRLRNYPIPLVAKTVDLHNDETEPLLTIRFWILSTLWVIVGCSVSSVYYFKPYSVRLSGYVVQLLSWGMGALMARYFPQKQYTLTLPILRKEISFNLNPGPWNPKEHALVIVAYWGSTYTAYGLGPLSAMELYYHKRMSGPWAVLFLMTTQLMGYGFAGVYRDVLVRPPGMYYPGVLPNVTLFNAMHRHPSVTKKSLGFFGVVAAAAFVYQWLPGFVMPLLASLPVVCWMGLGTKTAFVLGSGTYGFGLLDFSLDWNYASFLTPLYTPLWATVNRFVGAAVVIWVVYPLAYFLNVNGAQQFAPMSSGTWDAEGNRYNISRILTPTYELNRTALEEYSPPYWSFSYAMHFFWGFAASTAVLTYAVMFHGRQSWEALRSSLQTISNPFAKKDHKQKKKNSQQHRAEFDDPYLKLTAHLPRVPHWWYLALLFSCLVIAIAQVSGGGMQLPWWGLLLITAISALFTFPSGILFGFTNVQIGMDYLSELLAGFLFPGKPIAVLTCTVYGRQILEQCLNLVSDIKFGFYMKIPERELFVAQVYGTLLGPFVNWACMRLIIDTQGPKLTGEVVSGTTWNALKTKNFFSLSVIWGVLGPQVFFGDESPYRWVYWGFVVGPLAVTLLWLVQHRLARPKWGKVASVVNPVVMLNGATLFPIYPTTNLATSALVAVVFMGYVYRYHPVWFRKYNYLLGAGLDCGAQLVQMAMILVVDLPNVTMPHWWGNDAVAVDKCYPI

SEQ ID NO: 53 - DNA, 2616 bp, Neurospora crassa
  CDS (1)..(2616)
atggcgaccaccagagatgagaaggcagtgaacatcacccctgctgggagtgatcaagcttctgcttctcccgccaagtatgacgagaagatcgacggcattcatgaagttggccttgaccgtatggactcagaggaagcacaagttcttgaaggacatcttgatgttaccgaggaggacctcctccaagcaaaggccgcggccgagtccctcagtctcgaagaggttgtcaagttgatgaagaatgtagtcagcatgcatggacgcgatccaaactttccgcacgtggttcttgaaaagatccaggaattcctagccaacgagcagaacattctctcgaatccggaaaagtacgatgatatcatcaccgagatgaaaattgaagctgctctcatccagagcaacagtccctacgccgaagtgcgcgccgtggtcgacaataccgatgacccttccacgccgtgctcaaccattcgttcgtggaccattggcatcttgttctctgtcattctcgcctttgtcaaccagctcttcagtgtacgccagcccagcatttcgatcgaatccaacgttgctcagctccttgcttttcctctcggcaaagcctgggagatgtggatgccgtattacgagttcactctctttggaaccaagcataatctcaatccggggcggttcagcaagaaggaacacatgttgatcgccatcatggcaaacacagccaagtcgctgccctacacgcagtacattgtgtggacccaggtgctgccgcaatactttaaccaaccatatgcgaacagctttgcgtaccagattctaattgcgttgagcaccaacttcatcggctatggccttgctggtatcactcgccggttcatcgtgtatccatcttactgcgtctggcccgcatctttggttaccatcgccctcaactcggctctgcaccacgaggagaaccatatagttcctggcccgttcaagaagctgtacagaatgtcgcgcttcaagttcttcatgtgggctttcggcgcaatgttcgtgtacttctggttccccaactatctctttgaagccttgacattcttttcttggatgcagtggattgctcccaacatgttcaaccccttccccacatttgactggaacgttttgcttttcgactccgtcgatcctctcatggtgcctgctttcaccacgttcaataaaaccttcggcatggcgtttttcggcttcatcatcctaggaatttggtacactaatgtttggaataccggtcacctcccaatcaacagcaaccgtgtgtttgaccactacggtagtctgtacaacgtctcgcgagccattgacgagaagggcatgtttgacgaggcgaagtacatggattacagcgccgcatatctttcagcagccaacgccattgtgtatttcgctttctttgccatctatgcggccaccatcagccatatcatccttttccatcgggccgagatcgccattggcttcaggaatatctggaaaactgtgaagccaaagagatggacaaagagaaatgctgccggagagagtgtcgaggaagaggatgttggatacaaggacgtgcataaccgtttgatggctgtttatcccgaagtttcggaactgtggtacttgggctgcctcgtgattgccatggcacttggctttgctggtgttgccgcctggcccacatatactactgctggtgtcgttccctacggcctgttccttgcaataattttcgtcatccctattggcatcatcaaggccatgacgggtatcgaagtcaccttgaacgtattggccgagtttatcggtggtgcttgggttgagggcaacgccttggccatgaactttttcaagtcctttggatatgtgacctgcgcgcatgccatcagcttcgccaacgacctcaagctcgctcactacatcaagattcctcctcgccacactttcaccgcccagatggtggccacgctcatttccactttcatctgcaccggtgtgctcaacttccaagtcaacattgagaacatttgccagaccaacgcgcccatgcgtttcttctgccccggcatcaacaccttctttactgccgccgtcttgtggggaaccattggtcccgtcaaggtgtttggaattcatggccagtacaagtggctccttctgggcttccccatcggtctctgcattcccgtcatcttttggctcatcatccgcaagttcccgcgcaacaagttcattcgtcagttccaccccgtggccttgttctatggcgcactcaactgggcgccatacagcatgagctactgctggccagcggtgcccattgcgtggttgagctggatctatgtgcgaaaccgatacctggcgttctggtccaagtacaactttgtgttgagcgccgcgtttagcgcgggtatcgcgcttagcggtatcgtgatgctgttctcggtgcagtgggctagagtgagtgtggagtggtggggtaacacccagccgtacaagggctgtgaggataccgcttgcacgatcaagacgttgtccgagggagagaggttctttccctggtgggacgcgaacaaggtgccggccccttaa

SEQ ID NO: 54 - protein, 871 aa, Neurospora crassa
MATTRDEKAVNITPAGSDQASASPAKYDEKIDGIHEVGLDRMDSEEAQVLEGHLDVTEEDLLQAKAAAESLSLEEVVKLMKNVVSMHGRDPNFPHVVLEKIQEFLANEQNILSNPEKYDDIITEMKIEAALIQSNSPYAEVRAVVDNTDDPSTPCSTIRSWTIGILFSVILAFVNQLFSVRQPSISIESNVAQLLAFPLGKAWEMWMPYYEFTLFGTKHNLNPGRFSKKEHMLIAIMANTAKSLPYTQYIVWTQVLPQYFNQPYANSFAYQILIALSTNFIGYGLAGITRRFIVYPSYCVWPASLVTIALNSALHHEENHIVPGPFKKLYRMSRFKFFMWAFGAMFVYFWFPNYLFEALTFFSWMQWIAPNMFNPFPTFDWNVLLFDSVDPLMVPAFTTFNKTFGMAFFGFIILGIWYTNVWNTGHLPINSNRVFDHYGSLYNVSRAIDEKGMFDEAKYMDYSAAYLSAANAIVYFAFFAIYAATISHIILFHRAEIAIGFRNIWKTVKPKRWTKRNAAGESVEEEDVGYKDVHNRLMAVYPEVSELWYLGCLVIAMALGFAGVAAWPTYTTAGVVPYGLFLAIIFVIPIGIIKAMTGIEVTLNVLAEFIGGAWVEGNALAMNFFKSFGYVTCAHAISFANDLKLAHYIKIPPRHTFTAQMVATLISTFICTGVLNFQVNIENICQTNAPMRFFCPGINTFFTAAVLWGTIGPVKVFGIHGQYKWLLLGFPIGLCIPVIFWLIIRKFPRNKFIRQFHPVALFYGALNWAPYSMSYCWPAVPIAWLSWIYVRNRYLAFWSKYNFVLSAAFSAGIALSGIVMLFSVQWARVSVEWWGNTQPYKGCEDTACTIKTLSEGERFFPWWDANKVPAP

SEQ ID NO: 55 - DNA, 3285 bp, Neurospora crassa
  CDS (1)..(3285)
atggaaaacgcaaccttgacgccaacactgtatcccctcatcgaggctgtcgatccattgcaaatcgaattggcaatgaccatgactcgcgggcaggaaaacagattccgtatgacgcctgaccgagataggagtccttcacccgacatacctttcttcttggatgattctgatcatcatccaagcttcccgcttcgtgaactgctacatcaagctgtactgccggccggcaccaattcgtcaaccaccactcgagggcagccgacgccaacctcgtcgcactcttcacaagactttgaagtctcactcattggctcgacacaagatcgggatcgcgttaatacgttgcctgggcgggacgagcccgtccagaccttacctggcaatgcccatggactactccagcaacttcacttacacgaggagacgggtggcgacaacgcagatagcgacaacgatagcacaccaagcgagcccgtatctgaagaattcatgaccacaagacaaccttcccttctctccgtagcgccggggcgagacagtccctcctacggagccataacctccgcgccagcccgggcgaccagtgctccccaatccgaagggggcgaaccatccgctcgcgccgagtcccgctccgaaagcagtgctcggtttcgaacaggtcatgatccaaccggcaggagctcgacgggggacagctgcgatggatctgtgggaagatcgtccgagcgactttccttgtcgctgcagaaatctggcgaatggggtggctcaatgacaatgcgaggaatcgagggtcgttttgaagccgaggtaccgctcgaaggagagtctttgctggaccatatcgatgagttgaacgagttcgatgaaactgaggaggacccggccgacaactctccctacgcacaagtacgggcttcagttgcgcccactgacaatacgacactttccatcaacactccacgaatgtggaccttggccgtgctattttctattatcggatcttccaccaacttgttcttctcgttgagataccccagtgttgccatcacgcctgtcatcgcactcctatcaacccatccccttggtctcatgtgggacttcttcctcaaacgagcggacgaccccccagaagagtatgttgatggatgtcggacagatagtgccaatatcccggttgaccacccgaccgatgagcaaccacgtgtttttgttccctgggaaaaaagaagcaagctcgaccagctgcgactatggctcgctcagggtcgctggaacgagaaggaacatagttgcgtctatgtcagcagcaatgtctccttcggctttgcctttgcgacggatgttatcgttgagcaaacccagttttacaagcaggatgccccgatactctaccagattctcctcaccctctctactcaaattatgggctacaccttcgccgggctcacacggggattccttgtccggccaagcggcatgatatggcccggtacgctcatgtcggccgccatgtttactaccattcacaagcaggagaaccacgtggcgaatgggtggaagatgactagatggaagttcttcatggtcgtgttcctcgctggctttctcttctactttgtacccggccttttgttccccgcattgagctatttcaacgtcatcacctggtttgctcccaagaatgttgttgttgccaatctctttggtgtcgtgtctggcttgggattatttcccatgacatttgactgggcccagattgcctatatcggatcgcctcttctaacaccattttgggcagccatgaacgtggttggcggtcttgtcgtggtcatgtggattattgcccctatcgcatactacagcaactggctttactcctcatatatgccgatattatcagcagccgttttcgacaacacaggccaggtatatgatgtcagcaggatccttacggaggattttgttttcgatcgcgaagcctattcgaagtatagcagagtcttcctccccatcacctatgtcctcggctatgccgttcaatttgccggcctggcctctctacttacacataccatatgttggcacggcagagacatttgggctcagtggaagcaaaccctgggcgagatgcatggtgccgagcccaagggctcgtatgagccggttgcagtgtcgaccgaggggctcagtcggacttggagtcggttgagctcaagatcaagctttactaggtctaattcgagcacggagaatattatgaatagggaagacgtacataaccggctgatgaggaggtacaaggatgcacccatgtcgtggtatctcatcacttgcatattaatgctggctatcggtatctttgtcgttgaatactacccagttcacctgccttggtacggcttgctcctcgctctcggaatctgcagcatcctcttcatccctatcggcatcatcatggcagtcaccaaccagcacagcagcatttacctgatctgccagctcgttgctggcgccgtctttcccggccgacccgtcgcgaacatggtctttgtgacttacggatacatctcctcggcgcagggcatcaagttcgctgccgatctcaaactaggccactacatgaagataccaccccggatcctcttctcagttcagatggtagcgaccatcgtctcctcgctcacgcagatcggcgtcctcaactggatgttcaagaacgtccccggcctttgcactccagaggccctcaacgggttcacgtgccccattgcccgtgtgcacttcaatgggtcaattctatggggcgtcgttggccctagcgagttcttcggccccggggcaacctaccgaccgctcgtttgggcgttcgcagtcggagccgtcctacccattccgctgtggctgtacgcacgcaagaggaaggatagtattgtgcggaaactcaaccttcccgttctctttgggtcgttgggctggatcccgccagcaacaggcttgaacttttccgtgtgggctctcgtttgctacgtgttcaactacgtgataaagaaccgggcgcgagcgtggtgggccaagtacacaatgacgctcagcgccgcgctggattcgggcctggcgtttggtattgtggtggtgtttttcgggttcatctatcccggggtggtcaaagggtttagttggtgggggacggaagtgtataaacaaggatgtgattggcaggcttgtgcgtatcaggcggtgccggaggggggaaggtttgggcctgatgtttggtag

SEQ ID NO: 56 - protein, 1094 aa, Neurospora crassa
MENATLTPTLYPLIEAVDPLQIELAMTMTRGQENRFRMTPDRDRSPSPDIPFFLDDSDHHPSFPLRELLHQAVLPAGTNSSTTTRGQPTPTSSHSSQDFEVSLIGSTQDRDRVNTLPGRDEPVQTLPGNAHGLLQQLHLHEETGGDNADSDNDSTPSEPVSEEFMTTRQPSLLSVAPGRDSPSYGAITSAPARATSAPQSEGGEPSARAESRSESSARFRTGHDPTGRSSTGDSCDGSVGRSSERLSLSLQKSGEWGGSMTMRGIEGRFEAEVPLEGESLLDHIDELNEFDETEEDPADNSPYAQVRASVAPTDNTTLSINTPRMWTLAVLFSIIGSSTNLFFSLRYPSVAITPVIALLSTHPLGLMWDFFLKRADDPPEEYVDGCRTDSANIPVDHPTDEQPRVFVPWEKRSKLDQLRLWLAQGRWNEKEHSCVYVSSNVSFGFAFATDVIVEQTQFYKQDAPILYQILLTLSTQIMGYTFAGLTRGFLVRPSGMIWPGTLMSAAMFTTIHKQENHVANGWKMTRWKFFMVVFLAGFLFYFVPGLLFPALSYFNVITWFAPKNVVVANLFGVVSGLGLFPMTFDWAQIAYIGSPLLTPFWAAMNVVGGLVVVMWIIAPIAYYSNWLYSSYMPILSAAVFDNTGQVYDVSRILTEDFVFDREAYSKYSRVFLPITYVLGYAVQFAGLASLLTHTICWHGRDIWAQWKQTLGEMHGAEPKGSYEPVAVSTEGLSRTWSRLSSRSSFTRSNSSTENIMNREDVHNRLMRRYKDAPMSWYLITCILMLAIGIFVVEYYPVHLPWYGLLLALGICSILFIPIGIIMAVTNQHSSIYLICQLVAGAVFPGRPVANMVFVTYGYISSAQGIKFAADLKLGHYMKIPPRILFSVQMVATIVSSLTQIGVLNWMFKNVPGLCTPEALNGFTCPIARVHFNGSILWGVVGPSEFFGPGATYRPLVWAFAVGAVLPIPLWLYARKRKDSIVRKLNLPVLFGSLGWIPPATGLNFSVWALVCYVFNYVIKNRARAWWAKYTMTLSAALDSGLAFGIVVVFFGFIYPGVVKGFSWWGTEVYKQGCDWQACAYQAVPEGGRFGPDVW

SEQ ID NO: 57 - DNA, 2544 bp, Neurospora crassa
  CDS (1)..(2544)
atggcgcaaaacgtcaccgagatccacgatatgggcgtggacaagaagtctagcccatacgatgagggccacatcgacgaaaaggccccccatgactttgcggctgaggaggccaccgttgaccgtgccgtcgaagctgacttcagtgtcaccgagcaggatctcctggaggccaaggccctcgccgacagcatgtcgctcgaggaagtccgagccctcatggagcaggtcctcaaaattcacggcaacgatcccaacttcccccacaccatcatgaccaagatcgaggagttcctgggcaacgccaacatcctcacgaatcccgaaaagcatgaagagattatctacgagatgaagatcgaggccgcccttatcaccaacaactcgccctatgccgaggtccgtgccgttgtcgacaaccatgatgatcccaccatgccctgctccaccatccgtgcctgggtcatcggtctcatcttctccggtgctctcggtgccatcaaccagctcttctccatccgtatgcctgccattactgtcggcctcaacgtcgcccagctgttggcctaccctgttggcaagatttgcgaaaaggctcttccagatgtcggcttcaccctcttcggctctcgccacagcctcaaccctggtcccttcagccgcaaggagcacatgcttatcaccatcatggccaacgttgctggcagcactccttacaccaacaacatcatctggtctcagtaccttcccgagtacttcaaccagtcctacgccggccagtttagctaccagatcctggtcgccctctccaccaacttgatcggctacggcatggctggcttgactcgtcgattcctcgtctaccccagctactgcgtctggcccgcctctctcgtcactattgctctcaacaacgcctttcacaccgagtcgaacgtgccagtgcttggccccctcaagaaggtcttctccatgtcgcgttacaccttcttcttgtgggctactttggccatgtttgtctacttctggcttcccaactacctcttccttgctctcagcgccttcagctggctgtcgtggatctctcccaataacatggtcctcagcaacatcaccggattcaacaacggtctcggcctcaacccgtggcccaccttcgactggaacgtcctgcttttcgacggcaccgacccgctcatggttcccttcttcagcactcttaacaagttcctgggaatgttctgctccttcttcgtcgtcattggtatttggtggaccaacacctacaatacaggctacctgcccatcaactcgaacaaggtctacgacaacacgggcaatcgctacgacatctcccgtgccatcaacgagaagggtctgttcgatgctgcaaagtacgaggcctactcacctgcctacctggctgccggcaacttggttatctacctcttcttctttgccatctatcctgccaccctcacttacatcctgctcaaccaccgctacgaagtctccatgggtttcaagaacctctggaactcgcttcgcaggaacaagaacactgaggctggccaatacaaggatgtgcacaaccgtctcatggccgtctaccccgaagttcccgagtggtggtacctgattatcctgttgggcgccatcggctgcggcattggtggtatcgccggctgggagacctacaccacccctgccgtcgtcttctacggtctcattctctgctttatttttgttatccccgtcggtatcgtcaaggccatgacgggcatggaggttactctgaacgtcttggccgagtttatcggtggttcttgggtacaaggtaacgcactcgccatgaactacttcaagtccttcggctacgttacctgcgcccacgcggtctggttcgccaacgaccttaagctcgcccattatgtcaagatcccgcccaagcacacgttcgctgcccaggtcgtcgccacgctcgtttccaccttcatctgcaccggtatcctcaacttccagatgaacgacatccccagggtctgcactaacgaagcccccaacaagatgacgtgcccgggcatcaacaccttcttcacggcctcggtcctctggggtaccatcggccccaagaagatctttggtcacaacggccagtacacggccctcatgctcggctggcccctcggtctcctcctccccgtcattacctggtacattcagaagaagttcccccagaagaagtggctgcgccagattcaccccatcgtcctgttgtacggagccatgtactgggcgccttacaacttgtcgagccgcttccttggcttctggtccaagtacaacttcgtgctgtcggccgctttcaccacgggtatctcggtcgctgctgtcatcatctttttcagcttggactggtcgggtgtcgaagttagctggtggggcaacgacgtggtgtcggaagggtgcgagggtaagccttgcttgttgaagacgttgaaggagggagagatttttgggcccggacccgggcagttccattaa

SEQ ID NO: 58 - protein, 847 aa, Neurospora crassa
MAQNVTEIHDMGVDKKSSPYDEGHIDEKAPHDFAAEEATVDRAVEADFSVTEQDLLEAKALADSMSLEEVRALMEQVLKIHGNDPNFPHTIMTKIEEFLGNANILTNPEKHEEIIYEMKIEAALITNNSPYAEVRAVVDNHDDPTMPCSTIRAWVIGLIFSGALGAINQLFSIRMPAITVGLNVAQLLAYPVGKICEKALPDVGFTLFGSRHSLNPGPFSRKEHMLITIMANVAGSTPYTNNIIWSQYLPEYFNQSYAGQFSYQILVALSTNLIGYGMAGLTRRFLVYPSYCVWPASLVTIALNNAFHTESNVPVLGPLKKVFSMSRYTFFLWATLAMFVYFWLPNYLFLALSAFSWLSWISPNNMVLSNITGFNNGLGLNPWPTFDWNVLLFDGTDPLMVPFFSTLNKFLGMFCSFFVVIGIWWTNTYNTGYLPINSNKVYDNTGNRYDISRAINEKGLFDAAKYEAYSPAYLAAGNLVIYLFFFAIYPATLTYILLNHRYEVSMGFKNLWNSLRRNKNTEAGQYKDVHNRLMAVYPEVPEWWYLIILLGAIGCGIGGIAGWETYTTPAVVFYGLILCFIFVIPVGIVKAMTGMEVTLNVLAEFIGGSWVQGNALAMNYFKSFGYVTCAHAVWFANDLKLAHYVKIPPKHTFAAQVVATLVSTFICTGILNFQMNDIPRVCTNEAPNKMTCPGINTFFTASVLWGTIGPKKIFGHNGQYTALMLGWPLGLLLPVITWYIQKKFPQKKWLRQIHPIVLLYGAMYWAPYNLSSRFLGFWSKYNFVLSAAFTTGISVAAVIIFFSLDWSGVEVSWWGNDVVSEGCEGKPCLLKTLKEGEIFGPGPGQFH

SEQ ID NO: 59 - DNA, 2406 bp, Neurospora crassa
  CDS (1)..(2406)
atgcttcgcaatttttttcgacgacggcacggcgatgaggatgttatgccggatatggtagacgatggatcgctggaaggtgactcgactggcattgaggccttgactgcactgaagcggttcgaaaagatgcatcgcctggacccaaacctaccattggacgagctggacgaggtcgaaacggctttgaatagcgcaaacatcgagaaaggaaccgagatcgaccaaatattggctgaagacaattccccatatccagaagttcgagcttcagtacgaaattacgatgtcgagatgcccgtcaacaccatccgggcctggactatcggcatgttgctttgcactatcggttccgctgtcaatatgcttctctcgttgcgaaaccctagcatctcgttgtcgactttggctatccaactcatagcataccccatcggcctgggctgggatctcatcttccccgaccgtgttttcaccgtattcggcatcaagttcaacctcaaacccggaccattcaacttcaaggaacatgtcatcattgttgtcatgtccaatgctgcgtatggcggtggtgctttgtatgctactgatgtcattcttgctcaggagatctggtacaaacagtcattcggctgggcctggcaaatcctcttcggcatctcgacgctctgcactggctatgggcttgccggtttggcaagaaggttcttggtttggcccgctgccatgatatggcccgcggatctcattaactgcacactcttctacaccctccacgatcactcgccctcggatccggcaaggacaaatggttggtcaatcagccgataccgatggttcttgattgtcatggccggatcatttgcgtggtactggtttcctggctatctttttcagggactatcttggatgtgctggattacctggatctggcccgacaacgtcattgtcaatcagctgtttggcggacaaagcggatatgggctattccctatcactcttgattggtctatcatctctgggtatctcctgtcacccctcgcgtcgccatttcatgcgatcgccaacgtcgtcggcggtgtcacgtttttcttcgttattgtctcccttggaatccaatattcgaatatatggtactcagcttatctgccagtccaagagtcgcactcgtacgacaacaccggaaagaggtacgtcgttttgcgcattcttaacgaaaacctgcatttcgacgaggccaagtaccacgcatactcgccgctttacctccccacccagtttgcccttgcatatgggctgtcttttgcagctgtcgcagccgtcattgttcacgttggcctctaccacggcaaggacatctggaatcagtggaagttggcccgtcatcaagaagacgatgtccacatgcgcctcatgaagaaataccgtgacgccgaggattggtggtatattatcctatttgccgtcatgcttggtatgtcctttgccgtggtgtgcgcctgggataccggctttccatggtgggcgtttatcatctgcatattgattccggtggtgtggaccattccgatcggaatcattcaggccattaccaatattcaattaggactgaacgtcttgaccgagtatgtcatcggctacatgctccccggccgccccttggtcatgatgatgttcaagaactacggttatctcgtcatgtcgcaggcgctctatttcattcaggatctcaagctcggccattacatgaaggtgccacctcgtgtcatgttttggtcccagctgatagcttcggtttggtccgccattgtccagatcgccgtcatgaactgggcgctcggggcaattcccgatatttgcacagacggccaggccaaccaattcgattgccccagtgccaaggtatttttcactgcgtccgtcatttggggtgcgattggaccggcccgcatgttctccggtaaagcactgtatagctctttacagtggttctggctggttggtgccgttgctcccgtgatttcgtggtttttcgttcgacggtatccgcgctcgctttggcgctatgtcaacttcccgctggtgtttggcggttcaggctggattccgcccgcaactgtttacatctactactgctggggcatagtcggcactgtcttcaactttttcattcgccgtcggaagacgggttggtggctgcagtacaactacctcacctcggccgcccttgacgttggccttttgctgtcgactctcgttatattcttttccctcacactatcacacaccaaagcgccagaatggtttggcaacacagtggctaagagcaccatggatacgaccgccacagcggtacagaaactcgttccgccaggagagatctttggacctcgcgaatggccatag

SEQ ID NO: 60 - protein, 801 aa, Neurospora crassa
MLRNFFRRRHGDEDVMPDMVDDGSLEGDSTGIEALTALKRFEKMHRLDPNLPLDELDEVETALNSANIEKGTEIDQILAEDNSPYPEVRASVRNYDVEMPVNTIRAWTIGMLLCTIGSAVNMLLSLRNPSISLSTLAIQLIAYPIGLGWDLIFPDRVFTVFGIKFNLKPGPFNFKEHVIIVVMSNAAYGGGALYATDVILAQEIWYKQSFGWAWQILFGISTLCTGYGLAGLARRFLVWPAAMIWPADLINCTLFYTLHDHSPSDPARTNGWSISRYRWFLIVMAGSFAWYWFPGYLFQGLSWMCWITWIWPDNVIVNQLFGGQSGYGLFPITLDWSIISGYLLSPLASPFHAIANVVGGVTFFFVIVSLGIQYSNIWYSAYLPVQESHSYDNTGKRYVVLRILNENLHFDEAKYHAYSPLYLPTQFALAYGLSFAAVAAVIVHVGLYHGKDIWNQWKLARHQEDDVHMRLMKKYRDAEDWWYIILFAVMLGMSFAVVCAWDTGFPWWAFIICILIPVVWTIPIGIIQAITNIQLGLNVLTEYVIGYMLPGRPLVMMMFKNYGYLVMSQALYFIQDLKLGHYMKVPPRVMFWSQLIASVWSAIVQIAVMNWALGAIPDICTDGQANQFDCPSAKVFFTASVIWGAIGPARMFSGKALYSSLQWFWLVGAVAPVISWFFVRRYPRSLWRYVNFPLVFGGSGWIPPATVYIYYCWGIVGTVFNFFIRRRKTGWWLQYNYLTSAALDVGLLLSTLVIFFSLTLSHTKAPEWFGNTVAKSTMDTTATAVQKLVPPGEIFGPREWP

SEQ ID NO: 61 - DNA, 2262 bp, Oryza sativa
  CDS (1)..(2262)
atggcgtcctcccatcaccaagaagtacaagagcaaggccatggagatggagaggaagaggaacaagataatagccaaatcacctctccactgttgcgatcctcaatgcggctcggctcgccggaggagaactcgccggtggagcaggtggcgctgacggtgccggtgggggacgacccggcgacgccggtgctgacgttccggatatgggtgctgggcacggcgtcctgcgtcgtgctgtccttcctcaacaccttcttctggtaccgcaaggagccgctcaccgtcacggccatctcggcgcagatcgccgtcgtgccgctcggccgcctcatggccgccgcgctgccggagcgcgtcttcttccgtggccggccgtgggaattcaccctcaaccctggcccgttcaacgtcaaggagcacgtgctcatcaccatcttcgccaacgccggtgccggttccgtcttcgccattaacgtcatcaccgccgtccgagtcttctacgggaagcgcatctccttcttcgtctccctcctcgtcgtcctcaccagccaggtgctgggattcgggtgggcgggaatattccggcggtatctggtggagccggcggcgatgtggtggccgtccaacctcgtgcaggtctccctcttcagggcacttcatgaaaaggaacggaggagcaaaggcggcatgacacgcacccagttcttcttggtagcatttgtgtgcagctttgcctactacattttcccaggctacctattccagatgctcacttccctctcctggatttgttggatctttcccaaatctgtgctcgcacaacagcttggatcaggtctccatggccttggcattggtgcaattggactcgactggtcatccatctcgtcatatctcggaagcccactggctagcccatggtttgccactgccaacattgctgccggcttcttcatctacatttatgtaatcacaccaatcgcctactggattaatctctacaaggcacaaaacttccctatcttttcagatggccttttcacagtgactggacagaagtacaacatctctaccattatagactcacagtttcattttgatacaaaagcctatgagaagaatggaccattatacatcagcaccttcttttctatcagctatggtcttggttttgcatgtcttactgcaacagttgtccacgttcttcttttccatggaagatcagcttttcaagataaaaagatggacatacatacaaagcttatgaagaggtacaaacaggttcctgaatggtggttcatctccatccttatagccagtgttgcaatcaccatgttcacttgtgagtattacatagaacaattgcagttaccctggtggggggtactacttgcatgtgcccttgcaattttcttcacccttccaattggaatcgtcacagcaacgacaaaccagactccaggcttgaatatcatcacggaatacatcatggggtacttgtatcctggacgacctgtcgcaaacatgtgcttcaaggtatatggttacattggcccacagcaagccctagcattcctacaagattttaagctgggacactacatgaagattccaccaaggaccatgtttatggctcaggtggtgggcactttgatagcagcatttgtgtaccttggaacagcatggtggctcatggatacaatccctaacatatgcaacaccgagctcctccccccaggcagcccttggacctgcccttatgatcatttattctatgatgcatcagtcatatggggccttattggcccacgcagaatatttggtgatttaggcacttattctgctgtcaactggttcttcttggggggtgccattgctcccctcctcgtctggtttgcacacaaggcattcccaggtcagaaatggatcctacttgtcaacatgcctgtgctgatcgccggaatcagccagatgcctcctgccacttcagtcaactacacggcatggatatttgtagcatttttgtcaggttatgtggtctataagtaccgtcgtgactggtgggagagacacaattatctactttcaggtgcccttgatgctggtttggcattcatggctgtcttgctatatttatgcctaggactagagaaaatcagtttgaactggtggggtaatgatttggatggttgtccattagcttcttgccccattgcggaaggtataactgtacaggggtgtccagtggcaagtgcatag

SEQ ID NO: 62 - protein, 753 aa, Oryza sativa
MASSHHQEVQEQGHGDGEEEEQDNSQITSPLLRSSMRLGSPEENSPVEQVALTVPVGDDPATPVLTFRIWVLGTASCVVLSFLNTFFWYRKEPLTVTAISAQIAVVPLGRLMAAALPERVFFRGRPWEFTLNPGPFNVKEHVLITIFANAGAGSVFAINVITAVRVFYGKRISFFVSLLVVLTSQVLGFGWAGIFRRYLVEPAAMWWPSNLVQVSLFRALHEKERRSKGGMTRTQFFLVAFVCSFAYYIFPGYLFQMLTSLSWICWIFPKSVLAQQLGSGLHGLGIGAIGLDWSSISSYLGSPLASPWFATANIAAGFFIYIYVITPIAYWINLYKAQNFPIFSDGLFTVTGQKYNISTIIDSQFHFDTKAYEKNGPLYISTFFSISYGLGFACLTATVVHVLLFHGRSAFQDKKMDIHTKLMKRYKQVPEWWFISILIASVAITMFTCEYYIEQLQLPWWGVLLACALAIFFTLPIGIVTATTNQTPGLNIITEYIMGYLYPGRPVANMCFKVYGYIGPQQALAFLQDFKLGHYMKIPPRTMFMAQVVGTLIAAFVYLGTAWWLMDTIPNICNTELLPPGSPWTCPYDHLFYDASVIWGLIGPRRIFGDLGTYSAVNWFFLGGAIAPLLVWFAHKAFPGQKWILLVNMPVLIAGISQMPPATSVNYTAWIFVAFLSGYVVYKYRRDWWERHNYLLSGALDAGLAFMAVLLYLCLGLEKISLNWWGNDLDGCPLASCPIAEGITVQGCPVASA

SEQ ID NO: 63 - DNA, 2268 bp, Oryza sativa
  CDS (1)..(2268)
atgggcgagggcgagttcgtcgacgtcgagcgcggcgtggtcgctgaaggggcgttggacgacgacgcgtcgccgatcgaggaggtccggctgacggttccggtcactgacgactcgtcccttccggtgtggacgttccggatgtggacactcggcctgctctcgtgcgtgctcatgagcttcctgaaccagttcttctcctaccgcaccgagccgctcatcgtcacccagatcaccgtgcaggtggcctcgctgcctctgggccacatcctcgcccgcgtgctgccgcgccgcaagttcaaggcccccgcgctgctcggcggcggggagtgcagcctcaacccggggcccttcaacatgaaggagcacgtgctcgtctccatcttcgccaacgccggctgcgccttcggcagcgggtccgcctacgccgtcatgatcgtcgacatcatccgcgccttctacgggcggtccatctccctcttccccgcatggctcctcatcaccaccacgcaggtgctcggctacgggtgggcggggctgatgcgcaggtacgtggtggagccggcgcaaatgtggtggcccggcacgctcgtgcaggtgtcgctgttcagggcgctgcacgggaagggggaagagaaggaggagaataaggagggcagcggcggcgggatgtctcaggccaagttcttcctgatcgcgctcgcctgcagcttcctgtggtacgccgtgccgggttacctgttcccgacgctgacctccgtctcgtgggtctgctggatcttctccaagtccgtcacggcgcagcagctgggctccggcatgaagggcctgggcctcggcgccttcaccctcgactggacggccgtgtcagccttcctgtacagcccgctgatctcgccgttctttgccaccgccaacatcttggccggctacgtgctcctgatgtacgtggtcgtgccggtgtcgtactggggcctcgacctgtacaacgcccggaggttccccatcttctcgtcgcacctgttcacggccaccggcagcacatacgacatcacggccatcgtgaacgaccgcttcgagatcgacatggacgggtaccatcggatggggcggatcaacatgagcacgttctttgcgctgtcctacgggctcggcttcgcgacgatcgcggccaccgtcacgcacgtggcgctgttccacgggaaggagatctaccgccggttccgcgcgtcgcagagggacaagcccgacgtgcacacgaggctgatgaagagctaccgcgacgtgccgagctggtggttctacgcgatgctcgcgctgtccatggccgtctcgctcttgctctgcaccgtcctcaggtcggcggtgcagctcccgtggtggggtctcctcttcgcctgcgccatggccttcgtgttcacgctgccgatcagcatcatcacggccacgaccaaccagacgccagggctcaacatcatcaccgagtacgtcatcgggctcatgcttccgggcaagcccatcgccaacgtctgcttcaaggcgtacggctacatgagcatgtcgcaggccgtgtccttcctgtccgacttcaagctcggccactacatgaagataccccccaagtccatgttcctcgtgaagttggtcggcacggtggtcgcctccacggtcaacctcgtggtggcgtactggctgctgggttccatccccaacatctgccaggacgcgctcctcccggcggatagcccgtggacgtgcccgaacgaccgcgtcttcttcgacgcgtccgtcatctggggcctcgtcgggccgcgccgcatcttcgggccactcggcaactacggcgcgctcaattggttcttcctcgctggcgccgtgggacccgtcattgtgtacttgctccacagggcgttccccagcaagacctggataccgatgatcaacctgccggtgctcatcggagcgacctcctacatgccgccggcaacggccgtgaactacaactcctggctgatcatcgggatcatcttcaacttcttcgttttccggtacaggaagctgtggtggaagaggtacaactacatcctctcggctgcgctcgacgccggcgtcgcgttcatggcggtgctgctctacttctcgctgtcgatggagaaccggagcatcagctggtggggtacggccggcgagcactgcccgctggcctcatgccctaccgccaaagggataaacttgggcgctgatagcgtctgccctgttgtgttataa

SEQ ID NO: 64 - protein, 755 aa, Oryza sativa
MGEGEFVDVERGVVAEGALDDDASPIEEVRLTVPVTDDSSLPVWTFRMWTLGLLSCVLMSFLNQFFSYRTEPLIVTQITVQVASLPLGHILARVLPRRKFKAPALLGGGECSLNPGPFNMKEHVLVSIFANAGCAFGSGSAYAVMIVDIIRAFYGRSISLFPAWLLITTTQVLGYGWAGLMRRYVVEPAQMWWPGTLVQVSLFRALHGKGEEKEENKEGSGGGMSQAKFFLIALACSFLWYAVPGYLFPTLTSVSWVCWIFSKSVTAQQLGSGMKGLGLGAFTLDWTAVSAFLYSPLISPFFATANILAGYVLLMYVVVPVSYWGLDLYNARRFPIFSSHLFTATGSTYDITAIVNDRFEIDMDGYHRMGRINMSTFFALSYGLGFATIAATVTHVALFHGKEIYRRFRASQRDKPDVHTRLMKSYRDVPSWWFYAMLALSMAVSLLLCTVLRSAVQLPWWGLLFACAMAFVFTLPISIITATTNQTPGLNIITEYVIGLMLPGKPIANVCFKAYGYMSMSQAVSFLSDFKLGHYMKIPPKSMFLVKLVGTVVASTVNLVVAYWLLGSIPNICQDALLPADSPWTCPNDRVFFDASVIWGLVGPRRIFGPLGNYGALNWFFLAGAVGPVIVYLLHRAFPSKTWIPMINLPVLIGATSYMPPATAVNYNSWLIIGIIFNFFVFRYRKLWWKRYNYILSAALDAGVAFMAVLLYFSLSMENRSISWWGTAGEHCPLASCPTAKGINLGADSVCPVVL

SEQ ID NO: 65 - DNA, 4069 bp, Yarrowia lipolytica
  CDS (698)..(3208)
cccgagaatttagttgatgatagttataagttcaagtatggcttaatacacttcactattgactttatattctgccgaattgtcagcgtaagcacatcaattgaccacgtgacctaactcccacgtgatctaaaacccccttcccccacttacccgtgcgatatctcctcaatccaccacccctccactctcttatttaggctgtaagacattttccttagttgaaccttgtaggcactccacctgcccaccaagggtttgaggatactctccaagtgttgataaagaagagcaaatggaaggcagagacaaagatactattcctagctcccttctatcttttcagatacgacttttatcgctcttcctcgcccgctgtcaacttaccctacctactgataagcgcatggccgtatgcacaagtctgcatgttgcgagatacggcacgaggacctgtgcatttttcagagcttcaccaaaacaatcaaacgggattggagcggcgtaaatcgacacaaacaggccttttctgttgttctacagtgataaggacgcgccagcgacttgaccggcgccacagaacacacaaaatacacaagacaacttatttattgcccccaccctttcatcatcataatcatcatcatcatcatccccttctgacaccctcagtatatgatcaatcaaccactaccacatgagccaatacagtcgccacgcgttcgataccgactccgactcggatacggagctgactccaatctacatcgatgaccgttactcgtcaatggtcagtaacgactccagagcaggcttactaagacgaggaggtgatctggaaagagacgccgagagcgaaaagacccgcgaagagaaagaggaggaattgagaaaccacagcttcagcaagtcaagggataaaacgagggagacagtcgccgacgccactctcgaatccagctcttgtgtagactcacaatacgacacagtggagacaacctctattttttctgtggggcgcaaaaaggccatcaattcaccgtatccagaagtacgggctgctgtacctgctactgacgaccctctaatgccgcaaaatacccccagaatgtgggtcattggcatctttctggtcaccatctgttctggactcaacatcctcttcactctgcattggccagcattcgtcatatcgtccttttttgcagccatggtggcatggcctctgggacgaatatgggaccagtttgtgccgaattggagaatccccctgactaacatctacctcaacaactcccccttcaacatcaaggagcattgcctgattatcgtcatggccaacgtctcctatggaacgggcgtctcctacgtccccgtcattgtgctgacgatgaaacacagatacaacaacacatatttcggctggggcttcagtattgtcagttccatttgtgtgcaatgtcttggttacggcatggcgggcatctgtagacgtatcttggtctatcctgcctctctcatctggcccagtaatttggtcaccaccacttttctcactaacattcacatgaatgtgaaccatactgccgacgggtggaagatttctcgtctgcggttttttctcattgttttttccgcctactttgtctggaactggttaccgggctatctggcgccttttttgtccaatttcgcctttgtgacgtacgcagctcccgacaatgtcattgtgaaccagattttcgggtcatcttccggcctggggctcatccccatcaacttcgactggaacgtcattgccggttacattggcagtcctctggttccgcctttcttctctatcggaaacgtggcagcaggagtggtggtcattttctggatcatcacccctattttgcactactccaacgcctggtacgggcgatacctgcccatgagcgattccaactcgtatgaccgatttcaaaggacttatgatgctgagagagtactcaaaccgcttgtcaagggcggtaaaaagaagtttgaattggatgtggaaaaatacaaagagtattcgccgttgtatctgtccacgacatttgctctttcctacggcgtctcctttgccgctatcacatccacggttgtccataccattcttttccacggcaaagaaatcatgtactactggaaacacagccgaaaggagccagaggatgtgcatatggaactcatgagaaagtatcccgaggtgcccgaatggtggtacgcactggttctagccatctgctttgccctggcttgtgtcacggtctccgtgtgggaaacagacttgcccatttgggctcttatcattgcccttctcatcgctggaggtctgcttatcccggcaggtatgattgcggcactgaccaacgtgaccatgggtctcaatgtgctaaccgagtttgtcgtgggctacattcttcccggacgaccggtcggcatgatgtttttcaaaacctttggctacatttcaaacgcacaagcgctcaactttttggtcgatctcaaactcggccactacctgaaactggctcctcgagtcatgttttgtgcccagatactggccacaacgtggggcagcatttgccagctggctgtggtggaatgggcacagatggcgatcccagatctgtgtgaagagtcgcaaaagacaaacttctcctgtccccaggtccaggtcttttactccgcgtccgtcatctggggcctggtgggacctggccgtattttcggcgaagggcagctgtaccatgggctcttgtggatgtttctggtgggtgcagccttgccttttttttcgtggctgtggctgaaacggcaccccaactctcggctcaagttcatccactggcctgtgttcttcaacgggccttctcaaattccgcccgccaccccctacaactacgcatcgtggtgtgtggtagggtacattttcaactggctgattaaacggcggtggttcaactggtgggccaagtacaactacacactgagtgcagggctggatgtggggatggctgtcagtgcagcggtcatttttgtgtcgttgcagctgcccaatatcaatcctccgtcgtggtggggaaccaacatctttacgccgacgatggatattcagggcaatgcttttcaggaggtgttgaaggagggcgagagttttggtatgaagacgtggaagtgaacggtgagtgcgagacaccagtacagggactattctgggttcaggcctcgaggcgtatgtctacatacaagtgctgtacgacaagtctctaccgttctcgtcaatggatcactatagaatgccgttcatgacggttctaaaaactgcatctcgaaaaagatatgagtcgatgtttgcataatagagtattagcatgtgattgagagagatgtgagtaactatgcatacaagttctgaacttgtaatgtacagtagagctgagttgttggcaggaggatgataggttggcgatgcttggctgttctatggctattctacagtacatcggtttattgcacttcacaacatcttgccaatagtggataaacagttgattctaacttgttgctcaaatcaaaactcatctcttcatactgagtggaatcatcactacttctaaacgccttgaagtggcagagttcacgccgcccgtgacgtgagtagcacacatgtcacctctcagatggtattatcgcatttgttagtttgctatccctgtctttggttctccctgttcgttcgtgaagtcagggctaaacggctttgtcatctctcccgactgaaatcaaggaacactttgagcacacttctagtggtaccaagtcgaatctggccgtgtcatgatcgctttcatctaattattacttccatagcgtctctagatggaaacttatctgacttcgtatgtggacttgagtaaatcagtacgggctatggataatgtcctagagatataatgtggtgccatatgggagctggcatgattctcaatgcgaaaagttgtattcccgtccatcatatctcttctcttgttctccaaaa

SEQ ID NO: 66 - protein, 836 aa, Yarrowia lipolytica
MSQYSRHAFDTDSDSDTELTPIYIDDRYSSMVSNDSRAGLLRRGGDLERDAESEKTREEKEEELRNHSFSKSRDKTRETVADATLESSSCVDSQYDTVETTSIFSVGRKKAINSPYPEVRAAVPATDDPLMPQNTPRMWVIGIFLVTICSGLNILFTLHWPAFVISSFFAAMVAWPLGRIWDQFVPNWRIPLTNIYLNNSPFNIKEHCLIIVMANVSYGTGVSYVPVIVLTMKHRYNNTYFGWGFSIVSSICVQCLGYGMAGICRRILVYPASLIWPSNLVTTTFLTNIHMNVNHTADGWKISRLRFFLIVFSAYFVWNWLPGYLAPFLSNFAFVTYAAPDNVIVNQIFGSSSGLGLIPINFDWNVIAGYIGSPLVPPFFSIGNVAAGVVVIFWIITPILHYSNAWYGRYLPMSDSNSYDRFQRTYDAERVLKPLVKGGKKKFELDVEKYKEYSPLYLSTTFALSYGVSFAAITSTVVHTILFHGKEIMYYWKHSRKEPEDVHMELMRKYPEVPEWWYALVLAICFALACVTVSVWETDLPIWALIIALLIAGGLLIPAGMIAALTNVTMGLNVLTEFVVGYILPGRPVGMMFFKTFGYISNAQALNFLVDLKLGHYLKLAPRVMFCAQILATTWGSICQLAVVEWAQMAIPDLCEESQKTNFSCPQVQVFYSASVIWGLVGPGRIFGEGQLYHGLLWMFLVGAALPFFSWLWLKRHPNSRLKFIHWPVFFNGPSQIPPATPYNYASWCVVGYIFNWLIKRRWFNWWAKYNYTLSAGLDVGMAVSAAVIFVSLQLPNINPPSWWGTNIFTPTMDIQGNAFQEVLKEGESFGMKTWK

SEQ ID NO: 67 - DNA, 2145 bp, Arabidopsis thaliana
  CDS (1)..(2145)
atgagaaagggagttctaaatcctgacagagatcgtcagatagtggaacatgagttgcaggaaactgggtttagtccagaaacagagaaagtcaagaacaagaattttgaagaagatgaagaggaagaagatgaatctgtggagaagatatttgagagtagagaagtaccttcttggaagaagcagttgacggtgagggcttttgtggtgagctttatgctaagcatcttgtttagtttcattgttatgaagcttaacctcacaacgggaatcatcccttcgctcaatgtctctgctggtcttttgggtttcttctttgtcaagacatggactaagatgctccataggtctggtctcttgaaacagccatttactcgccaggagaatactgttattcagacctgtgttgttgcctcttctggcattgccttcagcggaggttttgggacatacctctttggcatgagtgaacgaattgcgacccaatcaggagatgtatcccgtggcgtcaaggacccttctttgggttggattatcggtttcctctttgtcgtcagctttcttggcctcttctcagttgtccccctgcgaaagataatggtaatagacttcaaactaacatacccaagtggtactgcaacagctcatcttatcaacagctttcacaccactcaaggcgccaagctagccaagaaacaagtgagggtgttggggaaatttttctctttaagcttcttctggagtttcttccaatggttctttaccggaggagaaaattgtgggttctccaacttcccaacatttggactcaaagcttaccagtacaagttctactttgatttttcagcaacatatgttggtgttggaatgatatgtccgtatataatcaacatctctgtcctattgggaggaatcctctcttgggggataatgtggcccctcattgaaaccaaaaagggagattggttccctgataatgtcccatccagcagcatgcatggtctccaagcttacaaggtgtttatagctgttgctataatcctaggagatggcttatacaacttttgcaaggtgctgagccggactctttcaggattatttgtacagctccgaggccctactacatctatttcaagaacctccttcacacttgaagaagaccctcatgcttccccactaagcccaaagcaatcttatgatgaccaacgtcgtacaagattcttcctcaaagaccaaatccctacttggtttgctgttggaggttatatcacaatagctgcaacatctacagcgatactccctcacatgttccaccagctgagatggtattacattctggtcatctatatctgcgcgcctgtcttagctttctgtaacgcttatggagctggactcacagactggtccttggcttcaacttatggaaagttagccatattcacaattggagcttgggctggctctgagcacggtggtatgctggctggtctagcagcatgtggtgtcatgatgaacatagtctcgacagcttcggatctaacacaagacttcaagacaggctacctcactttatcatctccaaagtcaatgtttgtgagccaagtgattggaacagcaatgggttgtgtggtatctccttgcgtgttctggctattctacaaagcgtttgatgatttaggcctcccaaacactgaataccctgctccatttgctactgtatatcgaagcatggctaaactaggagtggaaggtgtcgcatctctaccgagagaatgtcttgttctatgctacgcgttcttcggtgtggcgattctcgtaaacatagtaaaagatagtctccatagcaattggggaaggttcattccacttcccatggcaatggctataccgtttttcttgggaccttacttcgcaattgacatgtgtgtgggaagtttgatactttttatctgggaaagagtagatgcagccaaggctgaagcttttgggacagcggtggcttctggtttgatatgcggagatggcatttggtctttgccgagctccgtgctcgctatagccggagttaatcctcctgtttgcatgaagtttctctcttctgcaaccaattcaaaggtcgacaacttcctgaaaggatccatttaa

SEQ ID NO: 68 - protein, 714 aa, Arabidopsis thaliana
MRKGVLNPDRDRQIVEHELQETGFSPETEKVKNKNFEEDEEEEDESVEKIFESREVPSWKKQLTVRAFVVSFMLSILFSFIVMKLNLTTGIIPSLNVSAGLLGFFFVKTWTKMLHRSGLLKQPFTRQENTVIQTCVVASSGIAFSGGFGTYLFGMSERIATQSGDVSRGVKDPSLGWIIGFLFVVSFLGLFSVVPLRKIMVIDFKLTYPSGTATAHLINSFHTTQGAKLAKKQVRVLGKFFSLSFFWSFFQWFFTGGENCGFSNFPTFGLKAYQYKFYFDFSATYVGVGMICPYIINISVLLGGILSWGIMWPLIETKKGDWFPDNVPSSSMHGLQAYKVFIAVAIILGDGLYNFCKVLSRTLSGLFVQLRGPTTSISRTSFTLEEDPHASPLSPKQSYDDQRRTRFFLKDQIPTWFAVGGYITIAATSTAILPHMFHQLRWYYILVIYICAPVLAFCNAYGAGLTDWSLASTYGKLAIFTIGAWAGSEHGGMLAGLAACGVMMNIVSTASDLTQDFKTGYLTLSSPKSMFVSQVIGTAMGCVVSPCVFWLFYKAFDDLGLPNTEYPAPFATVYRSMAKLGVEGVASLPRECLVLCYAFFGVAILVNIVKDSLHSNWGRFIPLPMAMAIPFFLGPYFAIDMCVGSLILFIWERVDAAKAEAFGTAVASGLICGDGIWSLPSSVLAIAGVNPPVCMKFLSSATNSKVDNFLKGSI

SEQ ID NO: 69 - DNA, 2391 bp, Arabidopsis thaliana
  CDS (23)..(2236)
tgacttcagaagaagaaagaaaatggacgcggagaaggctactgataagactaatgtccatctctcctcggaccatgagcgttgtccggtggaggaagtggctcttgttgtgcctgagacggatgatccaagcctaccggtgatgacattcagaacttggttcttgggtctgacctcttgtgttctgctcatctttctcaacacgttcttcacataccgtacgcagccactcaccatctcagccatcctcatgcagatcgctgttttgcccatcggcaagttcatggctcggactcttcccaccacttctcacaaccttcttgggtggagttttagcctcaatcctggtccttttaacatcaaggagcatgtcattatcaccatctttgctaattgtggcgttgcttacggtggtggtgatgcttactctattggggctatcactgttatgaaagcttactataaacagagccttagcttcatctgtggtctcttcatcgtcttgaccactcagattttgggttatggttgggctgggattctgaggaggtaccttgttgatcctgttgacatgtggtggccttcaaatctcgctcaagtttctctcttcagagcgttgcacgagaaggaaaacaagtctaaaggcttgacgaggatgaagttctttctagtagctcttggtgctagctttatttactatgcacttccaggctatctattcccaatcttgactttcttctcatgggtttgttgggcttggccaaacagcatcacggctcagcaggttggttcagggtaccatggccttggggttggagccttcactcttgactgggctggcatctctgcttaccatggtagtccattggtggctccatggtcctctatcctcaacgttggtgttggtttcatcatgtttatatacatcatcgtccctgtttgttactggaagttcaacactttcgatgccagaaagttccccattttctccaaccagctattcactactagtggccagaagtatgacacaaccaagatcttgacaccgcagtttgatctggatattggtgcttataacaactacgggaaactttacctcagccctcttttcgcactctctatcggatccgggtttgcgagattcactgcaacactaactcatgtggcattgttcaacggcagggacatatggaagcagacttggtctgcagtgaacaccacgaagctggacatccatggaaaattgatgcaaagctacaaaaaagtgcctgagtggtggttttatatattgctggcaggaagtgtagccatgtctctcctaatgtcttttgtgtggaaggagtcagtgcagcttccatggtggggaatgctctttgcttttgcattggccttcattgtcacactccctatcggtgtcattcaagcaactacaaatcagcaaccaggatatgatataatagggcagttcattatcggttatatcctgcctggaaaacccattgcaaacctgattttcaagatttacgggagaatcagcacagtccatgctctctcatttttggcagaccttaagcttggccattacatgaaaatcccaccgcgctgcatgtacacggctcagctggtgggcactgtggtagctggtgtggtgaatctgggagtggcctggtggatgttggagagcattcaagacatatgcgacatcgaaggagaccaccctaatagcccctggacttgccccaagtatagagtgacgttcgatgcttcagttatttgggggttgataggaccaagacggctctttggaccaggaggcatgtaccgtaaccttgtctggctcttcctcattggagctgtcctgcctgttcccgtgtgggcgctgagcaagatcttcccaaacaagaagtggatccctctcatcaacattccagttatctcctacggctttgcagggatgcctccagccactccaaccaacattgccagctggttggtcacaggaaccatcttcaactactttgtgttcaattaccacaagagatggtggcagaagtacaattacgtactctctgcagcgctcgatgcagggaccgcgttcatgggggtgctcttgttcttcgccctgcagaatgctggacacgacctcaaatggtggggcactgaagtagaccactgccctcttgcctcctgtcccacggctcctggaatcaaagccaaaggctgtcccgttttctaagctcagcagaattgattagattcaaacataaaaattcacatgttttgccctttctattgcttctttctgtacagccttctactgttagatggtggccatcagaatgcaataaactctaccttagattcatttgagaatgataatgagctattgag

SEQ ID NO: 70 - protein, 737 aa, Arabidopsis thaliana
MDAEKATDKTNVHLSSDHERCPVEEVALVVPETDDPSLPVMTFRTWFLGLTSCVLLIFLNTFFTYRTQPLTISAILMQIAVLPIGKFMARTLPTTSHNLLGWSFSLNPGPFNIKEHVIITIFANCGVAYGGGDAYSIGAITVMKAYYKQSLSFICGLFIVLTTQILGYGWAGILRRYLVDPVDMWWPSNLAQVSLFRALHEKENKSKGLTRMKFFLVALGASFIYYALPGYLFPILTFFSWVCWAWPNSITAQQVGSGYHGLGVGAFTLDWAGISAYHGSPLVAPWSSILNVGVGFIMFIYIIVPVCYWKFNTFDARKFPIFSNQLFTTSGQKYDTTKILTPQFDLDIGAYNNYGKLYLSPLFALSIGSGFARFTATLTHVALFNGRDIWKQTWSAVNTTKLDIHGKLMQSYKKVPEWWFYILLAGSVAMSLLMSFVWKESVQLPWWGMLFAFALAFIVTLPIGVIQATTNQQPGYDIIGQFIIGYILPGKPIANLIFKIYGRISTVHALSFLADLKLGHYMKIPPRCMYTAQLVGTVVAGVVNLGVAWWMLESIQDICDIEGDHPNSPWTCPKYRVTFDASVIWGLIGPRRLFGPGGMYRNLVWLFLIGAVLPVPVWALSKIFPNKKWIPLINIPVISYGFAGMPPATPTNIASWLVTGTIFNYFVFNYHKRWWQKYNYVLSAALDAGTAFMGVLLFFALQNAGHDLKWWGTEVDHCPLASCPTAPGIKAKGCPVF

SEQ ID NO: 71 - DNA, 2947 bp, Arabidopsis thaliana
  CDS (274)..(2541)
caaaattcatgtggtgtaaattgtctaaagtctgtatttttttttattgacatccattttttttgtgtcgaaagtctatatatgaagtcaaattcatgaacaaatgcttctaggctaaaaacgttatcgtaatctttaatcttcaggcttcttttctaaaattccgactggttaccgagggctagaaaatccggtcaccgtcgccggagacaacctcggtttctaaacgaaaccatcgtgaaggacggaaaaaaggagcttgaagacaaaacaatgacgagcgttttcgacgaacataaaccctccgatgactctcacgagtccaagatcgtcatcaatggagaagaagaggtgttggaggaggagaatgataatccgattgaagaagtccggttaacggtaccgataaccgacgatccaacactaccggtgctaacgtttcgaacatggactcttggacttttctcttgcatattgcttgccttcgtgaaccagttctttggtttccggtcgaaccagctttgggtatcttcagttgcggcacagatcgtgacccttccgctagggaaactcatggcaaagacgctaccgacaaagaaatttgggtttcccgggacgaattggtcgtggtcttttaaccctggtccgttcaatatgaaggaacatgttcttattacaatatttgctaacaccggagctggtggagtttacgccaccagtattattaccattgttaaagcgttttataatcgtcaacttaatgtcgccgccgccatgttgctcactcaaaccactcagttgttgggatatggatgggctggaatcttcaggaagttccttgtggattcaccgtatatgtggtggccgtcaaatttggttcaagtctcactctttagagctttacatgagaaggaggatctacaaaaagggcaacaaacaaggtttagattcttcatcattgtcttctgtgtgagctttgcttactacataatccccggctaccttttcccttccatttccgcaatttcatttgtttgctggatttggaaaagctcagtgaccgctcagattgtcggttctgggctcaagggtttaggtattggttcgttcggtcttgactggtccacagttgctggtttcttaggcagtccgttggctgtaccattcttcgccattgccaatttctttggaggattcttcatctttttatacattgttctacctatcttctactggactaatgcttatgatgctcagaagtttccgttctatacttcacacacctttgatcagactggacacacctataacattacccgtatcctcaatgagaagaatttcgatatcaatctagacgcttacaacggttacagcaagctctatttgagtgtgatgttcgcgttgctctatggactcagctttggttctctttgcgctaccatctctcatgttgccctctatgatggaaagtttatatggggaatgtggaagaaggcaaagacagcaacaaaggacaagtacggtgacgtgcattcgagattgatgaagaagaattatcaatcagtacctcaatggtggttcatcgcagttctagttatttcctttgctttcgcactctatgcttgcgagggctttgacaaacagcttcagctcccatggtggggacttatactcgcttgcgccatcgctttgttcttcacattacctatcggagttatccaagcaactactaaccagcaaatgggtcttaacgttataacagaactgatcatcgggtacttatacccaggaaagccactagccaatgtcgctttcaagacatacggatacatcagtatgtctcaagccttgtactttgtaggagacttcaagcttggtcactacatgaagattcctccaagatcaatgttcatcgtccagcttgttgcaactgtggttgcatcaactgtctgcttcggaacaacctggtggctcattacatccgtcgagaacatatgtaatgtcgatttgctcccggtgggtagtccatggacttgtcctggagatgaagtgttctacaatgcatcaatcatatggggagtgattggtccagggagaatgtttaccaaagaaggtatctatcccgggatgaactggttcttccttatcggtctcctcgctccagttcccttctggtacctatcgaagaagttcccagagaagaaatggctaaaacagatccatgttcccttgatcttctctgcagtaagcgccatgccacaagctaaggctgtgcattactggtcctgggccatcgttggggttgtgttcaactactacatcttcaggaggttcaaaacttggtgggcgaggcacaattacatcctctctgcggcgcttgatgcaggtactgcgattatgggagtgttgatattcttcgcattccagaacaatgatataagcttacctgattggtgggggcttgagaattcagaccattgccctctagcgcattgccctctagccaaaggtgttgttgttgaaggttgtcccgtgttttaagaattgaagtagatgcaacgttgtcctgaaaggggtaactgttgatggcttcggtaaccttatatctgtgtaaaaccctccaagttaagggactcaaacaatgtaaagcactagatttggtttcatgttcttcagtatttaactattccctttgtaagtataagaacagtagccaaataaagtagagctttcttcattccaactatataatcaaaatgtaacaagctccaaaagatatcattcaaatgatataactaaggtttaagatgtgtaccaattaaaagtaatttgagctctgttgcatagctggataatactttaacaagattcaagggaaattttaaacaatggtctccgagaacttttttgtttttcgacagaagatgatgaaagcaaaagtctagtt

SEQ ID NO: 72 - protein, 755 aa, Arabidopsis thaliana
MTSVFDEHKPSDDSHESKIVINGEEEVLEEENDNPIEEVRLTVPITDDPTLPVLTFRTWTLGLFSCILLAFVNQFFGFRSNQLWVSSVAAQIVTLPLGKLMAKTLPTKKFGFPGTNWSWSFNPGPFNMKEHVLITIFANTGAGGVYATSIITIVKAFYNRQLNVAAAMLLTQTTQLLGYGWAGIFRKFLVDSPYMWWPSNLVQVSLFRALHEKEDLQKGQQTRFRFFIIVFCVSFAYYIIPGYLFPSISAISFVCWIWKSSVTAQIVGSGLKGLGIGSFGLDWSTVAGFLGSPLAVPFFAIANFFGGFFIFLYIVLPIFYWTNAYDAQKFPFYTSHTFDQTGHTYNITRILNEKNFDINLDAYNGYSKLYLSVMFALLYGLSFGSLCATISHVALYDGKFIWGMWKKAKTATKDKYGDVHSRLMKKNYQSVPQWWFIAVLVISFAFALYACEGFDKQLQLPWWGLILACAIALFFTLPIGVIQATTNQQMGLNVITELIIGYLYPGKPLANVAFKTYGYISMSQALYFVGDFKLGHYMKIPPRSMFIVQLVATVVASTVCFGTTWWLITSVENICNVDLLPVGSPWTCPGDEVFYNASIIWGVIGPGRMFTKEGIYPGMNWFFLIGLLAPVPFWYLSKKFPEKKWLKQIHVPLIFSAVSAMPQAKAVHYWSWAIVGVVFNYYIFRRFKTWWARHNYILSAALDAGTAIMGVLIFFAFQNNDISLPDWWGLENSDHCPLAHCPLAKGVVVEGCPVF

SEQ ID NO: 73 - DNA, 2202 bp, Arabidopsis thaliana
  CDS (1)..(2202)
atgaaagactttacagatacaatatcggagtcggagtgcgacgatgagataagtatagttccacaagtggaactaacggtgcccaaaaccgacgatccaacttcaccgacggttacgtttaggatgtgggttcttggcataaccgcttgtgttctcttgtcatttcttaaccagtttttctggtacagaaccaatcctttgaccatctcctctgtttcggctcagattgctgttgttcccattggtcatctcatggctaaagttcttcccacaaggagattcttcgaagggacgaggtggtctttcacgatgaatcctggtccctttagcaccaaggaacatgttcttataactgtgtttgcaaactcaggctctggggctgtttacgctactcatattcttagtgctgttaagctttattacaagagaaggcttgatttcttacccgctttgctcgttatgatcaccactcaggtattgggatttggttgggctggtttgtataggaaacatttagttgagccaggtgaaatgtggtggccaagcaatctcgttcaagtgtctctcttcagagcattgcatgagaaagagaacaaatcgaaatggggaattagtcgaaatcagttctttgtcatcactctcatcactagcttctcctattatctcctacctggttatctcttcacggtcttaaccaccgtctcttggttatgttggattagccctaaatcgattctagtaaaccagcttggttcagggtcagcaggtcttggtatcggttcctttggtctggactggtcaaccatcgcgtcataccttggaagtccactcgctagcccattctttgcctctgcaaatattgcggccgggttctttcttgtgatgtacgtaatcacacctctctgttactatcttgatttgtacaacgccaaaaccttcccaatctactccggtaaactctttgtagccagtgggaaagaatacaaagtaacgagcatcatcgatgccaatttccgcctggatcgtcaggcttacgcagagaccggaccagtccacatgagcactttctttgccgtgacctatggactaggtttcgcgaccttgtctgctagtattttccatgtcctgattttcaacggcaaagatctctggactcaaaccagaggagcgtttggaaaaaacaagaaaatggatatacatacaaagatcatgaagaggaattataaagaagttcctctctggtggttcctttcgattttcgcggtgaatcttgcagttattgtcttcatatgtatttactataagacacagattcagcttccatggtggggagctttcttggcttgtttgatagctatcttcttcactcctctcgttggtgtgatcatggccactactaaccaggctccgggtctgaacattatcacggagtacataattggatatgcatatccagagagaccagttgctaacatatgcttcaagacttacggatacatcagcatgtctcaatctttgactttcctctctgatttaaagcttggaacttacatgaagatcccaccaagaaccatgttcatggcacaggttgtgggcactttagttgcagttatcgcttacgcaggcacggcttggtggctaatggctgaaatcccaaatctctgcgacactaatctgcttccaccgggaagtcaatggacttgtccatcggatcgagtcttcttcgacgcatcagtgatttggggactagtaggaccaagaagaatgtttggtgatcttggagaatactcgaacataaactggttcttcgtaggaggtgcaatagctccagcattggtatacttagcctcaagactcttcccaaacaagaaatggatctcagacattcacatccctgttctgattggagccacagctataatgccaccagcttctgcggtgaacttcacgagctggctcgttatggcgtttgtgtttggacatttcgtgtttaagtacagaagagaatggtggcagcgatataactatgttctgtctggaggaatggatgcaggaactggattcatgtcagtgcttttgtttcttgcgttgcaacgtagtgagattgcgattgattggtggggaaattctggagaaggttgtcctgttgctaaatgtccaactgctaaaggtgttgttgttcatggttgtcctgttttctaa

SEQ ID NO: 74 - protein, 733 aa, Arabidopsis thaliana
MKDFTDTISESECDDEISIVPQVELTVPKTDDPTSPTVTFRMWVLGITACVLLSFLNQFFWYRTNPLTISSVSAQIAVVPIGHLMAKVLPTRRFFEGTRWSFTMNPGPFSTKEHVLITVFANSGSGAVYATHILSAVKLYYKRRLDFLPALLVMITTQVLGFGWAGLYRKHLVEPGEMWWPSNLVQVSLFRALHEKENKSKWGISRNQFFVITLITSFSYYLLPGYLFTVLTTVSWLCWISPKSILVNQLGSGSAGLGIGSFGLDWSTIASYLGSPLASPFFASANIAAGFFLVMYVITPLCYYLDLYNAKTFPIYSGKLFVASGKEYKVTSIIDANFRLDRQAYAETGPVHMSTFFAVTYGLGFATLSASIFHVLIFNGKDLWTQTRGAFGKNKKMDIHTKIMKRNYKEVPLWWFLSIFAVNLAVIVFICIYYKTQIQLPWWGAFLACLIAIFFTPLVGVIMATTNQAPGLNIITEYIIGYAYPERPVANICFKTYGYISMSQSLTFLSDLKLGTYMKIPPRTMFMAQVVGTLVAVIAYAGTAWWLMAEIPNLCDTNLLPPGSQWTCPSDRVFFDASVIWGLVGPRRMFGDLGEYSNINWFFVGGAIAPALVYLASRLFPNKKWISDIHIPVLIGATAIMPPASAVNFTSWLVMAFVFGHFVFKYRREWWQRYNYVLSGGMDAGTGFMSVLLFLALQRSEIAIDWWGNSGEGCPVAKCPTAKGVVVHGCPVF

SEQ ID NO: 75 - DNA, 2226 bp, Arabidopsis thaliana
  CDS (1)..(2226)
atggacgagattgtagaagactcgagcagagtcatggagatagaaggacagaatgatgatctggaccggtgcgtggtggaggaggttgagctaaccgttccaaaaaccgatgatccaacgttaccggttctcacatttcgaatgtggactttaggtcttggtgcgtgtatcatactctcgttcataaaccagtttttctggtacagacagatgccgttaaccattagcggaatctcggctcagattgcggtcgtgccacttggtcacctgatggctaaggttcttcctacaaggatgttcttggaaggatcaaagtgggagttttctatgaatccaggtccttttaatgtcaaggaacatgtattgatcacgatttttgctaattcgggagctggaacggtttatgcgactcatatacttagtgcaattaagctctattataagagatctcttccatttctaccggcttttctccttatgatcacaacgcagtttctcggatttgggtgggctggtctattccgtaaacatcttgttgagcctggtgaaatgtggtggccaagcaatctagttcaagtgtctctcttcagtgccttgcacgagaaggaaaagaagaaaaagggaggcatgacccgaatccaattcttcctcattgtccttgttaccagttttgcatactacattctccctggttatttattcacaatgataacttccatctcatggatctgttggcttggtcccaaatcggttttggttcaccaactcggttcaggtgaacaaggtcttggtattggcgcaattggtattgactgggctacaattagctcttacctcggtagcccactcgcgagtcccttattcgctacaatcaatgtaaccatcggttttgtggtgatcatgtatgtcgccactccaatttgctattggctaaatatttacaaagccaaaacatatcccatcttctcaagtgggcttttcatgggcaatggctcgtcctatgatgttttaagcatcattgataagaagtttcatctcgaccgagatatatatgcaaagactggtcctatcaatatgagcactttctttgcagtcacatatggtcttgggtttgctactttgtccgcaactattgtccatgttttactcttcaacggaagggatttatggaaacaaacaagaggtgcttttcagaggaacaagaaaatggatttccacacgagaatcatgaagaaaaactatagggaagttcctatgtggtggttttatgtgatcctcgtactcaacattgcgctcatcatgttcatatcattctactacaatgcaaccgtgcagctaccttggtggggagtgttgctagcttgtgccattgctgtcttcttcactccgcttatcggtgttatcgccgccaccactaatcaggaaccgggtttgaacgtcattacggaatatgtaatcgggtatctctatccagaacgtccggttgctaacatgtgctttaaagtatatggatacatcagcatgactcaggctctaacattcatccaagacttcaaactcggactctacatgaagattcctcctagaagcatgttcatggcacaggtggttgggacgcttgtgtctgtggtagtgtacacaggaactgcttggtggttaatggtagacattcctcatctatgtgacaaatctttgcttcctccagatagcgaatggacatgtcccatggaccgtgtcttctttgatgcttcagttatttggggacttgtaggaccacgtagaatgttcggtaacttaggagaatacgcagccataaactggttcttcctcgtaggtgcaatcgctcctttctttgtctggctagcgaccaaagcattcccagctcataaatggatctcgaagattcattttccggtcattttaggagcaacctcgatgatgccacccgcgatggcggttaacttcacgagttggtgcatcgttgcatttgtgtttggacactttttgtataagtacaagagacagtggtggaaaaagtataactacgttttgtcgggtggtttagacgcgggcactgcgtttatgacaatacttatattcctatcggttggacgcaaaggaattggattgttgtggtggggaaacgctgatgatagcacaaactgtagcctcgcgtcttgtcctaccgctaaaggcgttattatgcatggatgtccagttttatga

SEQ ID NO: 76 - protein, 741 aa, Arabidopsis thaliana
MDEIVEDSSRVMEIEGQNDDLDRCVVEEVELTVPKTDDPTLPVLTFRMWTLGLGACIILSFINQFFWYRQMPLTISGISAQIAVVPLGHLMAKVLPTRMFLEGSKWEFSMNPGPFNVKEHVLITIFANSGAGTVYATHILSAIKLYYKRSLPFLPAFLLMITTQFLGFGWAGLFRKHLVEPGEMWWPSNLVQVSLFSALHEKEKKKKGGMTRIQFFLIVLVTSFAYYILPGYLFTMITSISWICWLGPKSVLVHQLGSGEQGLGIGAIGIDWATISSYLGSPLASPLFATINVTIGFVVIMYVATPICYWLNIYKAKTYPIFSSGLFMGNGSSYDVLSIIDKKFHLDRDIYAKTGPINMSTFFAVTYGLGFATLSATIVHVLLFNGRDLWKQTRGAFQRNKKMDFHTRIMKKNYREVPMWWFYVILVLNIALIMFISFYYNATVQLPWWGVLLACAIAVFFTPLIGVIAATTNQEPGLNVITEYVIGYLYPERPVANMCFKVYGYISMTQALTFIQDFKLGLYMKIPPRSMFMAQVVGTLVSVVVYTGTAWWLMVDIPHLCDKSLLPPDSEWTCPMDRVFFDASVIWGLVGPRRMFGNLGEYAAINWFFLVGAIAPFFVWLATKAFPAHKWISKIHFPVILGATSMMPPAMAVNFTSWCIVAFVFGHFLYKYKRQWWKKYNYVLSGGLDAGTAFMTILIFLSVGRKGIGLLWWGNADDSTNCSLASCPTAKGVIMHGCPVL

SEQ ID NO: 77 - DNA, 2310 bp, Oryza sativa
  CDS (1)..(2310)
atgaacatgatcgcaattcaccccatttacggctccagtttgctcgttttactggccccaggggaggttcaggacctggtggtggtcgtgttaggcgttaagttgttcgtccttttatcagtgcgatcctcaatgcggctcggctcgccggaggagaactcgccggtggagcaggtggcgctgacggtgccggtgggggacgacccggcgacgccggtgctgacgttccggatatgggtgctgggcacggcgtcctgcgtcgtgctgtccttcctcaacaccttcttctggtaccgcaaggagccgctcaccgtcacggccatctcggcgcagatcgccgtcgtgccgctcggccgcctcatggccgccgcgctgccggagcgcgtcttcttccgtggccggccgtgggaattcaccctcaaccctggcccgttcaacgtcaaggagcacgtgctcatcaccatcttcgccaacgccggtgccggttccgtcttcgccattaacgtcatcaccgccgtccgagtcttctacgggaagcgcatctccttcttcgtctccctcctcgtcgtcctcaccagccaggtgctgggattcgggtgggcgggaatattccggcggtatctggtggagccggcggcgatgtggtggccgtccaacctcgtgcaggtctccctcttcagggcacttcatgaaaaggaacggaggagcaaaggcggcatgacacgcacccagttcttcttggtagcatttgtgtgcagctttgcctactacattttcccaggctacctattccagatgctcacttccctctcctggatttgttggatctttcccaaatctgtgctcgcacaacagcttggatcaggtctccatggccttggcattggtgcaattggactcgactggtcatccatctcgtcatatctcggaagcccactggctagcccatggtttgccactgccaacattgctgccggcttcttcatctacatttatgtaatcacaccaatcgcctactggattaatctctacaaggcacaaaacttccctatcttttcagatggccttttcacagtgactggacagaagtacaacatctctaccattatagactcacagtttcattttgatacaaaagcctatgagaagaatggaccattatacatcagcaccttcttttctatcagctatggtcttggttttgcatgtcttactgcaacagttgtccacgttcttcttttccatggaagtgaaatttggcagctaagcagatcagcttttcaagataaaaagatggacatacatacaaagcttatgaagaggtacaaacaggttcctgaatggtggttcatctccatccttatagccagtgttgcaatcaccatgttcacttgtgagtattacatagaacaattgcagttaccctggtggggggtactacttgcatgtgcccttgcaattttcttcacccttccaattggaatcgtcacagcaacgacaaaccagactccaggcttgaatatcatcacggaatacatcatggggtacttgtatcctggacgacctgtcgcaaacatgtgcttcaaggtatatggttacattggcccacagcaagccctagcattcctacaagattttaagctgggacactacatgaagattccaccaaggaccatgtttatggctcaggtggtgggcactttgatagcagcatttgtgtaccttggaacagcatggtggctcatggatacaatccctaacatatgcaacaccgagctcctccccccaggcagcccttggacctgcccttatgatcatttattctatgatgcatcagtcatatggggccttattggcccacgcagaatatttggtgatttaggcacttattctgctgtcaactggttcttcttggggggtgccattgctcccctcctcgtctggtttgcacacaaggcattcccaggtcagaaatggatcctacttgtcaacatgcctgtgctgatcgccggaatcagccagatgcctcctgccacttcagtcaactacacggcatggatatttgtagcatttttgtcaggttatgtggtctataagtaccgtcgtgactggtgggagagacacaattatctactttcaggtgcccttgatgctggtttggcattcatggctgtcttgctatatttatgcctaggactagagaaaatcagtttgaactggtggggtaatgatttggatggttgtccattagcttcttgccccattgcggaaggtataactgtacaggggtgtccagtggcaagtgcatag

SEQ ID NO: 78 - protein, 769 aa, Oryza sativa
MNMIAIHPIYGSSLLVLLAPGEVQDLVVVVLGVKLFVLLSVRSSMRLGSPEENSPVEQVALTVPVGDDPATPVLTFRIWVLGTASCVVLSFLNTFFWYRKEPLTVTAISAQIAVVPLGRLMAAALPERVFFRGRPWEFTLNPGPFNVKEHVLITIFANAGAGSVFAINVITAVRVFYGKRISFFVSLLVVLTSQVLGFGWAGIFRRYLVEPAAMWWPSNLVQVSLFRALHEKERRSKGGMTRTQFFLVAFVCSFAYYIFPGYLFQMLTSLSWICWIFPKSVLAQQLGSGLHGLGIGAIGLDWSSISSYLGSPLASPWFATANIAAGFFIYIYVITPIAYWINLYKAQNFPIFSDGLFTVTGQKYNISTIIDSQFHFDTKAYEKNGPLYISTFFSISYGLGFACLTATVVHVLLFHGSEIWQLSRSAFQDKKMDIHTKLMKRYKQVPEWWFISILIASVAITMFTCEYYIEQLQLPWWGVLLACALAIFFTLPIGIVTATTNQTPGLNIITEYIMGYLYPGRPVANMCFKVYGYIGPQQALAFLQDFKLGHYMKIPPRTMFMAQVVGTLIAAFVYLGTAWWLMDTIPNICNTELLPPGSPWTCPYDHLFYDASVIWGLIGPRRIFGDLGTYSAVNWFFLGGAIAPLLVWFAHKAFPGQKWILLVNMPVLIAGISQMPPATSVNYTAWIFVAFLSGYVVYKYRRDWWERHNYLLSGALDAGLAFMAVLLYLCLGLEKISLNWWGNDLDGCPLASCPIAEGITVQGCPVASA

SEQ ID NO: 79 - DNA, 2580 bp, Oryza sativa
  CDS (31)..(2331)
gaactgagaaggctcgcagcacacacaaccatgatgctccaccacgaagcaagtgtgcaacaagcgcgagaggaagaagaagagcttgatcaccatggcgatccgatgatcacctcccctctcttgcgaccatcgacgtcgggcagctcgccggagaatggagaggaggagaactcaccggtggagctggtggcgctgacggtgccagtgagcgacgagccggagacgccggtgctgacgttcaggatgtgggtgctggggacggcgtcgtgcgcggtgctctccttccttaaccagttcttctggtaccgcaaggagccgctcaccatcaccgccatctccgcgcagatcgccgtcgtgccgctcggccgcctcatggcggcgacgctgccggagcacgccttcttccgtggccggccgtgggagttcacgcttaatccggggccgttcaatgtcaaggagcacgtgctcatcaccatcttcgccaactccggcgccggcaccgtctatgccatccacgtcatcaccggcgtccgtgtcttctacgggaaaaccctctccttcttcatctccctccttgtcgtcctcacaacacagtaccatcagatgctggggttcggctgggcgggaatattccggcgttatcttgttgagccggcgtctatgtggtggccatccaacctagtgcaggtctctctgttcagcgcacttcatgagaaggaagcacggagaaaaggtggcttgacgcggaaccagttcttcctggtggcattcgtctgcagctttgcatactacatcttcccaggctacctattccagatgctcacctccctctcctggatctgctgggtcttccccagctctgtccttgcccaacagcttggttcaggtctccgaggcctcggcgttggtgcaatcggtctcgactggtcatctatctcctcctaccttgggagccctcttgctagcccatggtttgccactgtaaatgttggtgttggcttcttcatcgtcatgtacataatcacaccaattgcatactggtttaatttctacaaggcacaaaatttccccatattttctgatggcctcttcacctcgactgggcaaaaatacaatgtatcaagcattgttgactcccatttccattttgacaccaaggcctatgagaagaatgggccactatacctcagtacttcccttcttgtcacatacggtgttggttttgcaacccttgctgcaacaattgttcatgctctcctcttccatggaagtgaaatttggctattaagtaaatcagcttttcaagaaaaaaggatggacatacacacgaaacttatgaggagatataaacaggtccctgagtggtggttcatatgcatccttattgctaacatcggaacgaccatatttgcttgtgaatactacaatgaggaactccaattgccctggtggggtgttttgtttgcatgctccattgcctttttcttcaccctcccaatagggataatcaaagcaacaacaaatcagactccaggcctgaatgtcatcacggagtacattattgggtatctgtaccctggacgacccgttgcaaatatgtgcttcaaggtatatggttacatcagcatgaaacaagctttggcatttcttgaagattttaagctgggtcactacatgaagattccaccgaggacaatgtttatggctcaggtggtgggaacttcaattgcagcatttgtgtatattggcacagcatggtggctaatggagacaatccccaacatctgcaacactgagctcctcccgtcagatagcccttggacctgcccaggtgaccatgtattctatgatgcatcagtcacatggggacttattagcccgcgcaggatatttggggacttaggcacttattcagctctaaattggttctttttgtgtggagctattgcccctctacttgtctggtttgcacacaagacattcccaggccagaactggatcttactcatcaagacgcctgtactaattggtgccaccttccagatgcctcctgctactgccgtcaactacacgacttggatacttgttgggttcttgtcaggttatgtggtctatagatatcgacgtgattggtgggagagacacaattatctgctttcaggtgcactggatgctggtttggctttcatggcggtcttaatttacttgtgcttaggcttggaggacatcagtctgaactggtggggaaatgacttggatgggtgtcctttggcttcttgtcccactgctaaaggtatagttgtcaagggatgtgcagtctatacttgaggatctcctattgcttcttgtcccactgctacagtgttacccagacctccatgggtgcaagccaatatgattagatctaatttgacccttgtcatctataaacatcagtagaaccagctttgattcatagctggaaattagcaatgtagtttcagggttagtggtcataacttgtatcctatcagtattctcgaaaaaacttgtatcctaccaaacaagttaaattttgatctaaaaaaaaaaaaaaaa

SEQ ID NO: 80 - protein, 766 aa, Oryza sativa
MMLHHEASVQQAREEEEELDHHGDPMITSPLLRPSTSGSSPENGEEENSPVELVALTVPVSDEPETPVLTFRMWVLGTASCAVLSFLNQFFWYRKEPLTITAISAQIAVVPLGRLMAATLPEHAFFRGRPWEFTLNPGPFNVKEHVLITIFANSGAGTVYAIHVITGVRVFYGKTLSFFISLLVVLTTQYHQMLGFGWAGIFRRYLVEPASMWWPSNLVQVSLFSALHEKEARRKGGLTRNQFFLVAFVCSFAYYIFPGYLFQMLTSLSWICWVFPSSVLAQQLGSGLRGLGVGAIGLDWSSISSYLGSPLASPWFATVNVGVGFFIVMYIITPIAYWFNFYKAQNFPIFSDGLFTSTGQKYNVSSIVDSHFHFDTKAYEKNGPLYLSTSLLVTYGVGFATLAATIVHALLFHGSEIWLLSKSAFQEKRMDIHTKLMRRYKQVPEWWFICILIANIGTTIFACEYYNEELQLPWWGVLFACSIAFFFTLPIGIIKATTNQTPGLNVITEYIIGYLYPGRPVANMCFKVYGYISMKQALAFLEDFKLGHYMKIPPRTMFMAQVVGTSIAAFVYIGTAWWLMETIPNICNTELLPSDSPWTCPGDHVFYDASVTWGLISPRRIFGDLGTYSALNWFFLCGAIAPLLVWFAHKTFPGQNWILLIKTPVLIGATFQMPPATAVNYTTWILVGFLSGYVVYRYRRDWWERHNYLLSGALDAGLAFMAVLIYLCLGLEDISLNWWGNDLDGCPLASCPTAKGIVVKGCAVYT

SEQ ID NO: 81 - DNA, 2361 bp, Oryza sativa
  CDS (1)..(2361)
atggcgtcctcccaccaagaagaccgcgaggaggaggaggagcacagccatggcgacgacgagatcaccgccccgttctctcagcaagatcgtcgtcatcgaagcttagctcatagctttttccggttggttgctgctctgatcggatcatgtgtatatgcagtgcggccatcgacgtcgagggggtcgccggagttggaggaggaggagaactcgccgatcgagcaggtggcgctgacggtgccggtgagcgacgagccggagacgccggtgctgacgttcaggatgtgggtgctggggacggcgtcgtgcgcggtgctctccttcctcaaccagttcttctggtaccgcaaggagccgctcaccatcaccgccatctcggcgcagatcgccgtcgtgccgctcggccgcctcatggcggcggcgctgccggagcgcgccttcttccgtgggcggccgtgggagttcacgctcaacccggggccgttcaatgtcaaggagcacgtgctcatcaccatcttcgccaactccggcgccggcacggtgtacgccatccacgtcatcaccgccgtccgcgtcttctacggcaagcacatctccttcttcgtctccctcctcgtcgtcctcaccacccaggtgcttggattcgggtgggcgggaatattccggcggtatctggtggagccggcggcgatgtggtggccgtccaacctcgtgcaggtctccctcttcagggcgcttcacgagaaggaagcaaggagcaaaggtgggctgacgcgcaaccagttcttccttgtggcattcatctgcagcttcgcatactacatcttcccaggctacctgttccagatgctcacctccctctcctggatctgctgggtcttcccccactctgtgcttgcacagcagctcggctcaggtctcagtggccttggcattggcgcgatcggtctcgactggtccaccgtctcctcctacctcgggagtcctcttgctagcccatggtttgccactgcaaatgttgctgctggcttcttcttcatcatgtacataatcacaccgattgcttactggttcaatttctacaaggcacaaaacttccccatattttctgatggtctcttcacctcaactggccaaaagtacaatatctcaagcattgttgattctcatttccatttcgacacaaaggcctacgagaagaatggtccactatacctcagcactttctttgctgtcacatatggcgttggttttgcatcccttaccgcaacaattgttcatgttctcctcttccacggaagtgaaatatggcaattaagtaaatcagctttccaagaaaaaaggatggacatacatacaaaacttatgaggagatataagcaggttcctgagtggtggtttgtctgcatcctcattgctaacattgccgtcaccatatttgcttgtgaatactacattgagcaactccagttgccctggtggggtgttttacttgcatgtgccattgccttcttcttcaccctcccaattgggataattacagcaacaacgaaccagactccaggcttgaacatcatcacagagtatatcatggggtacttgtaccctggacgaccggtagcaaatatgtgtttcaaggtatatggttacatcagcatgagccaggccctgacatttcttcaagattttaagttgggtcactacatgaagattccaccaaggaccatgtttatggctcaggtggtgggaactttgattgcagcatttgtgtacattggaacggcatggtggctgatggagacaattcccaacatctgtaacactgagctcctcccatcagatagcccttggacctgcccaggagatcatgtgttctatgatgcatcagtcatatggggtcttattagcccacgcagaatatttggggacttaggcacctactcggcggtaaactggttctttttgggtggagctattgcccctgtccttgtctggtttgcacacaaggcattcccaaaccagaactggatcttgctcataaacatgcctgtgctgattggtgccactggccagatgccgcctgccactgccgtcaactacacaacatggatacttgttggtttcttgtcaggttatgtggtctatagatatcgacgtgactggtgggagcggcacaattatctgctttcaggtgcattggatgctggtttggcattcatggctgttttgatttacttgtgcctaggcttggagaacatcagtttgaactggtggggcaatgacttggatggatgtcctctggcttcttgccccactgctaaaggtgtagttgttgacggatgcccagtctatacttga

SEQ ID NO: 82 - protein, 786 aa, Oryza sativa
MASSHQEDREEEEEHSHGDDEITAPFSQQDRRHRSLAHSFFRLVAALIGSCVYAVRPSTSRGSPELEEEENSPIEQVALTVPVSDEPETPVLTFRMWVLGTASCAVLSFLNQFFWYRKEPLTITAISAQIAVVPLGRLMAAALPERAFFRGRPWEFTLNPGPFNVKEHVLITIFANSGAGTVYAIHVITAVRVFYGKHISFFVSLLVVLTTQVLGFGWAGIFRRYLVEPAAMWWPSNLVQVSLFRALHEKEARSKGGLTRNQFFLVAFICSFAYYIFPGYLFQMLTSLSWICWVFPHSVLAQQLGSGLSGLGIGAIGLDWSTVSSYLGSPLASPWFATANVAAGFFFIMYIITPIAYWFNFYKAQNFPIFSDGLFTSTGQKYNISSIVDSHFHFDTKAYEKNGPLYLSTFFAVTYGVGFASLTATIVHVLLFHGSEIWQLSKSAFQEKRMDIHTKLMRRYKQVPEWWFVCILIANIAVTIFACEYYIEQLQLPWWGVLLACAIAFFFTLPIGIITATTNQTPGLNIITEYIMGYLYPGRPVANMCFKVYGYISMSQALTFLQDFKLGHYMKIPPRTMFMAQVVGTLIAAFVYIGTAWWLMETIPNICNTELLPSDSPWTCPGDHVFYDASVIWGLISPRRIFGDLGTYSAVNWFFLGGAIAPVLVWFAHKAFPNQNWILLINMPVLIGATGQMPPATAVNYTTWILVGFLSGYVVYRYRRDWWERHNYLLSGALDAGLAFMAVLIYLCLGLENISLNWWGNDLDGCPLASCPTAKGVVVDGCPVYT

SEQ ID NO: 83 - DNA, 2334 bp, Schizophyllum commune
  CDS (1)..(2334)
atggccaccgaggatgctctccccaagctcccgcatcgcccagagccggctcgcgagaagaccgatgggtccctcgacgagaaaatcgatgagaagctcaacaacaacaagggcgagggctttcaagacgagcccttcgaattggagacgcaggctcagctcgatcggcagcacgtcgtgacgactgggcaagacgtctcgcgctacgtcgtcaacctgcgcgatgacgaggaccccgcgctcaccttccggtcgctcgtactcggtaccgtcatagccggactgggtgcggccctctgtcaaatctacatcttcaagcccgttttggtgtcggtctctacggtctttctgttgctgctcatctactgcatcggcaatgcgtgggcggtgtttcttccaaagcggtctctcgtcaagggaactcgatttgaacgctacggcggcatcatcgagttcatcaatccgggtccgttcatgatcaaggagcatgtggtttctaccctcgtcgcgtcaacagctgcgtatggggcgacatcggtcaacaacttcgccgtacagcgactttactatgacacccatgtcggccccttgacggccgtctttgccacattttcgacgctgactttcggtatgggcctcgtcggcatcctgcgacccctcaccgtgtaccccgccgagatggtgtactggagcaacctgccgcaagtgaccgtattccaagccctgcacttcaaccgccacgaaagcaccaagcgcgtccgcgtcttttggtggggctttacaatcatgttcatctacgagctcttccctgcctacatctttcccctcctcaactccgtctccatcttctgcctcgcctcgcagaaggcgaagccgtcgacgcgggacgtgttcactaacatctttgggggcgggaacgcgaacgagggtctcgggttacttaacttcagcttcgattggcagtacattgggtcgaactatatgtcttaccctttgctgcagcaagccaactcctggatcggcttgggggcttgctatgtgatcatggcagccatctactactcgaacgcgtgggactccaagaactacaagatgctctccacctcaattttcaaccacaacggcaccgtgtacgaccaggccgccgtattcggcaagaacggtatcctcaacgagaccgcgctcgaggagtacggcttgccggcgatgacagggtcgaacgcgtgggcgaactttgcgcagaaccttgctatcggcgccctcatcgcccatgtcaccttgttctggagcggcgacatgcgcgacgctgtcctccacttccgcaacggaaagaagaccaacgatgatccgcactatcttgctatgcagaagtacaaggaggcgccgtggtggtggtacttcatcctcctctttctagctttcattgctggcctaatcgtctgcatcaagggcgagacctcccttccgtggtggtcgtacattgtctcgctcgctgttggcgccttcatcacgcccttctctaccattctgtatgggcgcatgggcaacggcatcgcaaccaacaacctcatgaagatgattcccggcgctctaaaccccggcaggccagttgctaacctctacttttccatgtggtcccacgacgtcgtctccacctcgatcggcctcgcgggcgatttgaaggttggccagtacacgaaggtaccgccacgggtcatgtttctcactcagctgtggggctgcattctcggcgccattgtgaactatgttgtcatgattagcatcgtcgacgcgcaacgcgaagtccttctcgacgcctctggcacgaacgtctggagtgggcagacgatccagagcctcaattcgcaagcggtgacctggtcgctggcaaaggagctctatagcgcgtcgggcccatacgttattgtcccgatcggcttggccattgggctcgtgccaccttttatccagtggctcatctcaaagcgatggccaacgattaagggaatcaaggtcgagtccatcatcctgcctatcatcttcaactacgcgcagacgatgtcgaagggcatcacctcgtatgtatcgacaagtatcgtgatcggtctcgtctcgcaactgtggttgcgccagcaccaccctgtctggtaccgcaagtacaactatattctcggcggcgccttcgacggcggggcgcaggtcatggtgtttattctctctttcgcggtatttggcgcaagtggagtcgaacggcctttcccttcttgggctggaaatcctgcgaaggggaacatcgactattgtaatggcaacggcgcgctggatgcttcatag

SEQ ID NO: 84 - protein, 777 aa, Schizophyllum commune
MATEDALPKLPHRPEPAREKTDGSLDEKIDEKLNNNKGEGFQDEPFELETQAQLDRQHVVTTGQDVSRYVVNLRDDEDPALTFRSLVLGTVIAGLGAALCQIYIFKPVLVSVSTVFLLLLIYCIGNAWAVFLPKRSLVKGTRFERYGGIIEFINPGPFMIKEHVVSTLVASTAAYGATSVNNFAVQRLYYDTHVGPLTAVFATFSTLTFGMGLVGILRPLTVYPAEMVYWSNLPQVTVFQALHFNRHESTKRVRVFWWGFTIMFIYELFPAYIFPLLNSVSIFCLASQKAKPSTRDVFTNIFGGGNANEGLGLLNFSFDWQYIGSNYMSYPLLQQANSWIGLGACYVIMAAIYYSNAWDSKNYKMLSTSIFNHNGTVYDQAAVFGKNGILNETALEEYGLPAMTGSNAWANFAQNLAIGALIAHVTLFWSGDMRDAVLHFRNGKKTNDDPHYLAMQKYKEAPWWWYFILLFLAFIAGLIVCIKGETSLPWWSYIVSLAVGAFITPFSTILYGRMGNGIATNNLMKMIPGALNPGRPVANLYFSMWSHDVVSTSIGLAGDLKVGQYTKVPPRVMFLTQLWGCILGAIVNYVVMISIVDAQREVLLDASGTNVWSGQTIQSLNSQAVTWSLAKELYSASGPYVIVPIGLAIGLVPPFIQWLISKRWPTIKGIKVESIILPIIFNYAQTMSKGITSYVSTSIVIGLVSQLWLRQHHPVWYRKYNYILGGAFDGGAQVMVFILSFAVFGASGVERPFPSWAGNPAKGNIDYCNGNGALDAS

SEQ ID NO: 85 - DNA, 2358 bp, Schizosaccharomyces pombe
  CDS (1)..(2358)
atgatcggttccatcaatgagtctcccatcgaggagcatatgaatgactccccctctacaaaggaaaaggccgactccgtcgacatctctgattacatcgttagccattccgatgacagtttatccaaagacatcaagaaagacacaaagtcctttctcgatgtcgaacatggtgaaattagtacggttgacgagtttgaggaagactctccttatccagaggttcgtgccgccgtccctcctaccgatgatccaagtatgccatgcaacaccattcgcatgtggaccattggtctcatctattccaccgttggtgccgccgtcaacatgttcttttcccttcgaaacccaaccgtcactttgagtgttttgatttccgagcttctcgcatacccagcattacagatttgggacttgattttccccgatcgcgaatttcgcattggacgtttaaagtttaattttaagcctggtccctttaacgttaaagaacatgctctcatcgtcgttatgtcgagtgtatcgtttggtaatgcctactccaccgatatcatcctcgcccaacgtgtacactacaaacagcgcttcggctttggctacgaaatctgtttgactttggccactcaacttatcggatacggattggctggtttatccagaagacttttggtccgtcctgctagtatgttgtggcctgtgaatctcgttcaatgcaccttgatcaagactttacatcgcaaagacttacgaaacgccgttgccaatggctggagaatttcccccttccgtttctttttgtacgtttttattgcttcattcatttggaattggttcccttcctacattttccaagccctttccctatttgcttgggtcacttggattcgtcctaatagtccaactgtaaatcaaatctttggtgaatccaccggaatctccatccttcccatgacttttgattggaatcaaatttccgcatacattctttcccccctcatggctcctgccgatgctttgatgaacattcttttgggcgtcattctattcttttggatcgtcactccagcccttaactttaccaacacgtggtatggtgattacctaccgatcagtagttctggtattatcgatcactttggtaatagctataacgttactcgcatcctcaccaaggatgctacgtttgatttggatgcctatcaaaactattctcccattttcatgtccaccacctacgctttggcatttggcctttccttcgcttccatcacttctgtcattttccacgtgatcctataccatggaaaagagatctacgacaggttacgcgatccacccgcacctgatatccatgaaaaactcatgaaagcctatgatgaagttcccttctattggtatttgagtgttttcttggcctttttcggcatgatgatgggtactatttatggttggaaaacggaaaccccttggtgggttatcattgtcggtgtcattttctctgctgtatggttcattccaattggcatcgttcaagctataaccaacatccagctaggcttgaatgtattcaccgagtttatcgttggttatatgtatcctggtcgtcctttggccatgatgattttcaagactgtcggttatattacaatgactcagggattggctttcgctgccgatctgaagtttggtcattacatgaagcttcctcccagaatcatgttttacacccaaatgattgccaccatatggtcttgctttgttcagatcggcgtattggattgggctttgggtaatattgataatgtttgccaggccgatcaacctgataattacacttgtcctaatgcaactgtcttttttaattcttccgttatttggggtgtaattggtcccaagagaatgttttctggaaaaaacacctatacgggattgcagtacttctggctcgctggcgtgctgggtacaattttgttctgggctctatggaagaaatggcctcaaaaatggtggggtcaattgaatggcccgctaatttttggaggtactggttatattcccccagctactcctgtaaactatctggcttggtctggaattggtctgttcttcaattattatctgaagaagatattcgcagactggtggcagaaatacaatttcacgctttctgctgctcttgatactggtacgcagttgtcggtcattatacttttcttttgcttacagttgcctatggttaatttcccagattggtggggtaatgatggtgcctttaatacgctggatgctacaggtgccgctgttaggaaactcgtcaatgagtcagcaggtgaattctttggtcccgccgaatggtaa

SEQ ID NO: 86 - protein, 785 aa, Schizosaccharomyces pombe
MIGSINESPIEEHMNDSPSTKEKADSVDISDYIVSHSDDSLSKDIKKDTKSFLDVEHGEISTVDEFEEDSPYPEVRAAVPPTDDPSMPCNTIRMWTIGLIYSTVGAAVNMFFSLRNPTVTLSVLISELLAYPALQIWDLIFPDREFRIGRLKFNFKPGPFNVKEHALIVVMSSVSFGNAYSTDIILAQRVHYKQRFGFGYEICLTLATQLIGYGLAGLSRRLLVRPASMLWPVNLVQCTLIKTLHRKDLRNAVANGWRISPFRFFLYVFIASFIWNWFPSYIFQALSLFAWVTWIRPNSPTVNQIFGESTGISILPMTFDWNQISAYILSPLMAPADALMNILLGVILFFWIVTPALNFTNTWYGDYLPISSSGIIDHFGNSYNVTRILTKDATFDLDAYQNYSPIFMSTTYALAFGLSFASITSVIFHVILYHGKEIYDRLRDPPAPDIHEKLMKAYDEVPFYWYLSVFLAFFGMMMGTIYGWKTETPWWVIIVGVIFSAVWFIPIGIVQAITNIQLGLNVFTEFIVGYMYPGRPLAMMIFKTVGYITMTQGLAFAADLKFGHYMKLPPRIMFYTQMIATIWSCFVQIGVLDWALGNIDNVCQADQPDNYTCPNATVFFNSSVIWGVIGPKRMFSGKNTYTGLQYFWLAGVLGTILFWALWKKWPQKWWGQLNGPLIFGGTGYIPPATPVNYLAWSGIGLFFNYYLKKIFADWWQKYNFTLSAALDTGTQLSVIILFFCLQLPMVNFPDWWGNDGAFNTLDATGAAVRKLVNESAGEFFGPAEW

SEQ ID NO: 87 - protein, 47 aa, Artificial Sequence
  Consensus
  misc_feature (1)..(1): Xaa is Val, Asp or Ile
  misc_feature (2)..(46): Xaa at positions 2-4, 6-8, 11-13, 15-16, 18, 20, 22, 24-29, 31, 33, 35-37, 39-40, 42-44, 46 is any amino acid
  misc_feature (5)..(5): Xaa is Val, Leu or Ile
  misc_feature (9)..(10): Xaa at positions 9-10 is Asp or Glu
  misc_feature (14)..(14): Xaa is Pro or Ser
  misc_feature (17)..(17): Xaa is Thr, Lys or His
  misc_feature (21)..(21): Xaa is Trp or Tyr
  misc_feature (23)..(23): Xaa is Leu, Ile or Val
  misc_feature (30)..(30): Xaa is Val, Leu or Met
  misc_feature (32)..(32): Xaa is Ser, Ala or Ile
  misc_feature (34)..(34): Xaa is Leu, Ile, Val or Met
  misc_feature (38)..(38): Xaa is Phe or Tyr
  misc_feature (41)..(41): Xaa is Arg, Lys or His
  misc_feature (45)..(45): Xaa is Leu, Ile, Val or Met
  misc_feature (47)..(47): Xaa is Ile, Val or Leu
XXXXXXXXXXXXXXXXXXQXXXXXXXXXXXXXXXXXXXXXXXXXXXX

SEQ ID NO: 88 - protein, 10 aa, Artificial Sequence
  Consensus
  misc_feature (1)..(1): Xaa is Asn, Ile or Leu
  misc_feature (3)..(3): Xaa is Gly or Ser
  misc_feature (5)..(5): Xaa is Phe or Trp
  misc_feature (6)..(7): Xaa is any amino acid
  misc_feature (8)..(8): Xaa is Lys or Gln
  misc_feature (10)..(10): Xaa is His or Gln
XPXPXXXXEX

SEQ ID NO: 89 - protein, 25 aa, Artificial Sequence
  consensus
  MISC_FEATURE (1)..(1): Xaa is Leu, Met or Ile
  MISC_FEATURE (2)..(2): Xaa is Gly or Ser
  MISC_FEATURE (3)..(3): Xaa is Tyr, Phe or Met
  MISC_FEATURE (5)..(24): Xaa at positions 5, 9, 11, 12, 15, 17-20, 23, 24 is any amino acid
  MISC_FEATURE (6)..(6): Xaa is Ala, Ser or Gly
  MISC_FEATURE (8)..(8): Xaa is Leu, Ile, Met or Val
  MISC_FEATURE (13)..(13): Xaa is Leu, Ile, Met or Val
  MISC_FEATURE (14)..(14): Xaa is Val, Ile or Leu
  MISC_FEATURE (16)..(16): Xaa is Pro or Ser
  MISC_FEATURE (21)..(21): Xaa is Trp or Tyr
  MISC_FEATURE (25)..(25): Xaa is Leu or Met
XXXGXXGXXRXXXXXXXXXXXPXXX

SEQ ID NO: 90 - protein, 19 aa, Artificial Sequence
  consensus
  MISC_FEATURE (1)..(1): Xaa is Asp, Asn or Ser
  MISC_FEATURE (2)..(18): Xaa at positions 2, 6, 8, 13-15, 17, 18 is any amino acid
  MISC_FEATURE (4)..(4): Xaa is Leu, Ile, Met or Val
  MISC_FEATURE (5)..(5): Xaa is Gly or Ala
  MISC_FEATURE (9)..(9): Xaa is Lys or Arg
  MISC_FEATURE (10)..(10): Xaa is Ile, Val or Leu
  MISC_FEATURE (11)..(11): Xaa is Pro, Ser or Ala
  MISC_FEATURE (16)..(16): Xaa is Phe or Tyr
  MISC_FEATURE (19)..(19): Xaa is Gln or Lys
XXKXXXYXXXXPXXXXXXX

SEQ ID NO: 91 - protein, 798 aa, Artificial Sequence
  consensus
  MISC_FEATURE (2)..(247): Xaa at positions 2-4, 6-8, 11-13, 15, 16, 18, 20-37, 39-57, 59, 61-67, 69-117, 123, 124, 128-157, 159-174, 176-186, 188, 190, 193, 194, 196-198, 200, 202-205, 208, 209,211-219, 221-243, 245-247 is any amino acid
  MISC_FEATURE (249)..(511): Xaa at positions 249-255, 257-261, 263, 265, 267-276, 278-298, 300, 301, 303-310, 313-322, 325, 326, 328-336, 338-349, 351-361, 363-372, 374, 375, 377-399, 401-495, 497, 499-501, 503-505, 507-509, 511 is any amino acid
  MISC_FEATURE (514)..(691): Xaa at positions 514-538, 540, 542-555, 557-561, 563, 565-581, 583-585, 588, 590, 592-598, 600-612, 614, 616-618, 620, 622, 625-627, 629-630, 632-656, 658-669, 671-679, 681, 682, 685, 686, 689-691 is any amino acid
  MISC_FEATURE (693)..(797): Xaa at positions 693-699, 701-709, 711-797 is any amino acid
VXXXVXXXDDXXXPXXWXRXXXXXXXXXXXXXXXXXXFXXXXXXXXXXXXXXXXXXXPXGXXXXXXXPXXXXXXXXXXXXXXXXXXXXXXXXXXXXXXXXXXXXXXXXXXXXXXXXXNPGPFXXKEHXXXXXXXXXXXXXXXXXXXXXXXXXXXXXXYXXXXXXXXXXXXXXXXQXXXXXXXXXXXGXGXAGXXRXXXVXPXXXXWPXXLXXXXXXXXXHXXXXXXXXXXXXXXXXXXXXXXXRXXXFXXXXXXXFXXXXXPXYXFXXXXXXXXXXWXXXXXXXXXXXXXXXXXXXXXGXXGXXXXXXXXDWXXXXXXXXXXPLXXPXXXXXXXXXGXXXXXXXXXXXXYXXXXXXXXXXXPXXXXXXXXXXGXXYXXXXXXXXXXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXHXXXMXXXYXXXPXWWXXXXXXXXXXXXXXXXXXXXXXXXXPXWXXXXXXXXXXXXXXPXXXXXAXWXXXXXXXXXXXXXXXXXGXXXPGXPXAXXXXXXXGXXXXXXXXXXXXXDXKXXXYXKXPPXXXFXXQXXXXXXXXXXXXXXXXXXXXXXXXXCXXXXXXXXXXXXCXXXXXXXXXSXXWGXXGPXXXFXXXXXXXYXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 92 - DNA, 22 bp, Unknown
  Primer
atggccaccgccgacgaattct

SEQ ID NO: 93 - DNA, 25 bp, Unknown
  Primer
ttatttaaccggacaaccatcaaca

SEQ ID NO: 94 - DNA, 31 bp, Unknown
  Primer
atattaattaaggttcaaacatcatatcttc

SEQ ID NO: 95 - DNA, 31 bp, Unknown
  Primer
ataccatggcgggttttgggaagcaccttgg

SEQ ID NO: 96 - DNA, 21 bp, Unknown
  Primer
tgacgccatttcgccttttca

SEQ ID NO: 97 - DNA, 27 bp, Unknown
  Primer
cagaaatggataaatagccttgcttcc

SEQ ID NO: 98 - DNA, 22 bp, Unknown
  Primer
caatacattacactagcatctg

SEQ ID NO: 99 - DNA, 29 bp, Unknown
  Primer
ataggtaccggttcaaacatcatatcttc

SEQ ID NO: 100 - DNA, 31 bp, Unknown
  Primer
atagtcgaccgggttttgggaagcaccttgg

SEQ ID NO: 101 - DNA, 29 bp, Unknown
  Primer
ataccatggggttcaaacatcatatcttc

SEQ ID NO: 102 - DNA, 33 bp, Unknown
  Primer
atattaattaacgggttttgggaagcaccttgg

SEQ ID NO: 103 - DNA, 2510 bp, Glycine max
  CDS (90)..(2306)
cgcatgatatgatcactgtcacggttacatgcacatgagatttgacttttaacaccatctttgtgttacaggaaaagtactcttttaccatggcttccacttttgaaggtggctcagactcagagaaagagaacactgttgagagtgaagaagaagagtgtccagtaaaacaagttgaactcaccgttcctaaaaccgatgatcccaccatgcagcttctcacgttcagaatgtgggttctgggggttctttcatgcgtgttgttgtcctttgtgaatcagttcttttggtacagaacacagcctctgattgtaacctcaatttcagctcagattgctgtggttcctattggccacttcatggcaaggactctgccaacacgtgtgttcttcaaggattcaaggtttgagttctcactcaaccgtggaccgtttaatatcaaagagcatgttctgataaccatctttgccaattctggtgctggaactgtgtatgctactcatattttgagtgctgtgaagctcatgtataaaagaaggctcgacttccttcctgctttgttagtcatgttaactactcagatcctggggtttggttgggcaggactgttccggaaatttctggttgagccaggggaaatgtggtggccatctaatctggtccaggtctcattattcagtgctctacatgagaaaagcaaaaggcctaaaggaggcacaacacgtacccaatttttcctcctcgtcttggtctcaggcttggcttactatgtgttccctggctatctgttttcaatgttgacatctttctcttggatgtgttggcttgcccccaagtcagtcctagtccaacaacttggttctggtttgaggggtcttggaattgcagcatttggaattgattggtctaccatttctgcttaccttggaagtccactagctagcccttggtttgctactgctaatattgctgttggtttttttcttgttatgtatgtgatgacaccaattgcttactggtctaatgcctatgaggccaagacttttccaatattttcaagcaagctgttcatgggaaatgactcactgtatgacatttcaactattgtcaactccgaattccatctcgatcggcaagcttattcaatcaacgggccagttcatctcagcacgttctttgcaatgacatacggcctcggatttgcagcactttctgctacagttgtgcatgttctgctctttcatggaagggaaatattgatgcaaagtaaaagggcctttggaaacagtaaaaaaattgacatacacacaagacttatgagaaggtacaaatcagtccccacgtggtggttttacatcattctagcagcaaacatagctcttattatatttatttgtgagtactacaacgaatcactccagttaccatggtggggtgtattgctagcttgtgcaatttccatcttcttcactcttccaatcggtataataaatgccactacaaatcagcaacccggtttaaacatcataacagaatacataattggttacatgtatccagagcgtcctgtggctaacatgtgctttaaggtctacggctacatcagcatggttcaagcattaacctttttgcaagacttcaaacttggacactatatgaagattccaccaagaacaatgttcatggcacaggtggtaggaacaatcttatcagtatttatatacacagtaacagcatggtggttgatgagaacaatccctcacctctgtgacactaccatgctggatcctgatagcccttggacttgcccaatggacaatgtgttctttgatgcctcagttatatggggtcttcttggaccgcgcagaattttcggagacctcggtgaatatgccaaagtgaacttgttcttccttggtggagctattgctccctttctagtttggcttgctcacaaggcatttccagagcaaagatggataactctaattcacatgcctgtgttgttgggtgctacatcgatgatgccacctgcaactgctgtgaacttcactagttggatactagttggctttctctcaggatacatagcatatagatacagacaagaatggtggaagcgctgcaattatgtgttgtctggtggtcttgatgctggaactgcctttatgacaatcttgctgtttcttgctttgaacaataacaacatcatgcttaactggtgggggaataaccctgaagggtgtcccttggctaattgtcctactgaaaaaggcattgtagttaaaggttgccctgtacattaatcattctcggacgacgagaaatgctagcaatacactttgtaacacactcttttcaacaatttcaacctatatcagaggctgcatcaataagagtgggtgtattactaatatttctcttctaagatttcattattgagctactttaagttaggtgggttaaaatttatagaaaagttatgtcttcagatgaaaaaaaaaaaaaaa

SEQ ID NO: 104 - protein, 738 aa, Glycine max
MASTFEGGSDSEKENTVESEEEECPVKQVELTVPKTDDPTMQLLTFRMWVLGVLSCVLLSFVNQFFWYRTQPLIVTSISAQIAVVPIGHFMARTLPTRVFFKDSRFEFSLNRGPFNIKEHVLITIFANSGAGTVYATHILSAVKLMYKRRLDFLPALLVMLTTQILGFGWAGLFRKFLVEPGEMWWPSNLVQVSLFSALHEKSKRPKGGTTRTQFFLLVLVSGLAYYVFPGYLFSMLTSFSWMCWLAPKSVLVQQLGSGLRGLGIAAFGIDWSTISAYLGSPLASPWFATANIAVGFFLVMYVMTPIAYWSNAYEAKTFPIFSSKLFMGNDSLYDISTIVNSEFHLDRQAYSINGPVHLSTFFAMTYGLGFAALSATVVHVLLFHGREILMQSKRAFGNSKKIDIHTRLMRRYKSVPTWWFYIILAANIALIIFICEYYNESLQLPWWGVLLACAISIFFTLPIGIINATTNQQPGLNIITEYIIGYMYPERPVANMCFKVYGYISMVQALTFLQDFKLGHYMKIPPRTMFMAQVVGTILSVFIYTVTAWWLMRTIPHLCDTTMLDPDSPWTCPMDNVFFDASVIWGLLGPRRIFGDLGEYAKVNLFFLGGAIAPFLVWLAHKAFPEQRWITLIHMPVLLGATSMMPPATAVNFTSWILVGFLSGYIAYRYRQEWWKRCNYVLSGGLDAGTAFMTILLFLALNNNNIMLNWWGNNPEGCPLANCPTEKGIVVKGCPVH

SEQ ID NO: 105 - DNA, 2404 bp, Glycine max
  CDS (40)..(2289)
ttgtagagaacacatacatacattttcattttcagaggaatgatcatggaagaatcctcggtacacgagatcaaaacccctctcctgtcatctaacaaggaggaagatgaagttggaagcagtactagccataggcagcaaaatgaagagaactcgcccataaaacaagtggccctaacggtgccaaccaccgatgacccatctcttccagttctgacgttccgaatgtgggtgttgggaactctatcatgcgtgctgctgtcgttcctgaaccagttcttctggtaccgcatccagcctctcaccatcaccgcgatctccgcccagatcgcggtggtgccgctcggccaactcatggccgcaacgatcactaagcgcgtgttcttcagaggaacacgctgggaattcactctcaatccgggacccttcaacgtcaaggagcacgttctcatcaccatcttcgccaactccggcgccggcaccgtctacgccatccacgttgttaccgctgtcaaaatcttttaccacaaacacatctccttctttgtctccttgcttgtggtcatcaccacacaggtattgggtttcggatgggctggcatatttagaagatacctggtagagccagcggcaatgtggtggccagcaaatttagttcaagtttcactcttcagggccctgcacgagaaggatgagcgaccaaagggagggttaacgcgatcgcagttcttcgtaatcgcatttttgtgcagcttcgcctattacgtgttccccggttacattttccaaatgctaacctccctctcttggatttgctggttatatcccaacaatgttctggcccaacaacttgggtcgggcctaaacgggcttggcataggagcaattgggcttgactggtccaccatttcgtcctacctcggaagcccactcgcaagcccatggtttgccactgccaatgtcgcggtgggtttcgtgtttgtgatgtacgttctgactccgctgtgctattggctcgacttgtacaacgccaaaaccttccccattttctcggacgaactcttcacggagaaaggtcaagtttataacatcacagccataatagactccaatttccacctagaccttgcggcttatgagagacaaggtagattgtacatcagcactttctttgccatgacctatggtgttggctttgctgcactcaccgccaccattatgcatgttgctctctttcacggaagagaaatatgggagcaaagtaaatcaagttttaaggaaaagagcgtggacattcacacgaagcttatgcggaggtacaaacaggtgcctgaatggtggttcgtgtgcatactcatggcaaccattgcagccaccgtcttcacctgcgaatactacaacgatcagctgcaactgccttggtggggtgttctcctcgcatgtgccattgctatattcttcactctccccattggaattattactgcaatcacaaatcagagtccggggttgaacataatcacggaatacatcatagggtacatctacccgggataccctgtggcaaacatgtgcttcaaggtttatggttacatcagcatgacgcaggccatcactttcttgcaagacttcaagcttggtcactacatgaaaatccctcccagaaccatgttcatgggacaggttgtgggaacgcttgtcgcgggttttgtgtatttgggcactgcgtggtggttaatggaaacgatcccagacatatgcaaagacacgtcctctgtatggacgtgtccaagtgacacagtgttctacgacgcatcggttatttggggtttgattgggccgagaagaatattcggagacctgggaacgtacgagaaagtgaattggttcttcctaggaggagccattgctccattactggtttggttggcggcaaggtcgttcccacaacaagagtggattaggctcataaacatgccagtgttgataggggccaccggaatgatgcctccggcgacggcggtgaattacacgagctggatcattgcggggtttctctctggcttcgttgtgttcagatacaagcccgaatggtggaagcgtcacaattatgtgctctcaggggcacttgatgcagggcttgccttcatgggggtgcttttgtatctatgccttggattggaggacattagtctcaattggtgggggaatgaccttgacggatgtacattggctcactgccccaccgccaaagtagtcgaggttcaaggttgtgccgttttcacttgaacataactgtaaattaaatcataattagggtgaatatgctagttaaggaattaaaacttaaaagtgaaaagtcttttcctaataaaaacattattaatgcaaaaaaaaaaaaaaa

SEQ ID NO: 106 - protein, 749 aa, Glycine max
MIMEESSVHEIKTPLLSSNKEEDEVGSSTSHRQQNEENSPIKQVALTVPTTDDPSLPVLTFRMWVLGTLSCVLLSFLNQFFWYRIQPLTITAISAQIAVVPLGQLMAATITKRVFFRGTRWEFTLNPGPFNVKEHVLITIFANSGAGTVYAIHVVTAVKIFYHKHISFFVSLLVVITTQVLGFGWAGIFRRYLVEPAAMWWPANLVQVSLFRALHEKDERPKGGLTRSQFFVIAFLCSFAYYVFPGYIFQMLTSLSWICWLYPNNVLAQQLGSGLNGLGIGAIGLDWSTISSYLGSPLASPWFATANVAVGFVFVMYVLTPLCYWLDLYNAKTFPIFSDELFTEKGQVYNITAIIDSNFHLDLAAYERQGRLYISTFFAMTYGVGFAALTATIMHVALFHGREIWEQSKSSFKEKSVDIHTKLMRRYKQVPEWWFVCILMATIAATVFTCEYYNDQLQLPWWGVLLACAIAIFFTLPIGIITAITNQSPGLNIITEYIIGYIYPGYPVANMCFKVYGYISMTQAITFLQDFKLGHYMKIPPRTMFMGQVVGTLVAGFVYLGTAWWLMETIPDICKDTSSVWTCPSDTVFYDASVIWGLIGPRRIFGDLGTYEKVNWFFLGGAIAPLLVWLAARSFPQQEWIRLINMPVLIGATGMMPPATAVNYTSWIIAGFLSGFVVFRYKPEWWKRHNYVLSGALDAGLAFMGVLLYLCLGLEDISLNWWGNDLDGCTLAHCPTAKVVEVQGCAVFT

SEQ ID NO: 107 - DNA, 2415 bp, Glycine max
  CDS (73)..(2283)
attttgagaaggctccaaaaggcacctctttctttctctctagctaacatcacgtaggcactcacgcacgccatgagctctgatccagaaaagcgggtgacaagcgaggtggtggaagacgatgaactctctcccatcgaggaggttcgtctcaccgtaaccaacaccgacgacccgacccgaccggtatggaccttccgtatgtggttcctgggtcttctctcctgctccctcctctcctttctcaaccagttcttcgcttaccgcacggagcctctcatcatcacacaaatcacagttcaggtcgctactctccctatcggccacttcatggccgcgtttctgcccacaaccacgttcagcatccccggattcgggtccaagagcttctccttcaacccgggcccgtttaacatgaaggagcacgtgctcattaccatattcgccaatgccggaagcgcattcggatccgggtcaccctatgcggtgggtatcgttaacattatcaaagccttttacggacgcagcatctcctttgctgcttcttggcttctcatcattacaacgcaggtgctaggatatggatgggccgggttacttagaaaatacgtggtggaaccggcccatatgtggtggcccagtaccctcgtccaagtctcacttttccgagctttgcatgagaaagatgaccaccgactttcacgggcaaagttcttctttattgcactagtgtgcagtttttcgtggtatgttgtccctggatacttgttcacaacgctcacaaacatttcatgggtgtgttggatattctccaagtcagttacagctcagcagatagggtcaggcatgaggggccttggagttggtgccctcacacttgattgggctgccgtggcatcattcttgttcagccctctaatctcacccttctttgccattgtcaatgtttttgtgggctatgcattaattgtctacgtggtcattcctgtatcatactggggcctcaatgtgtacaatgccaataggtttcccattttctcctcacacttgttcaccgcccaaggtcaaaaatacaacatacctaagattgtagacaaccattttgagctaaatgttgcagagtatgaaaagcaaggtagaattcatctcagtgtgtttttcgctctcacttacggctttggatttgccaccatagcatccaccctcacacatgttgtctgcttctatggaagggagattatggagcggtatcgtgcttcttccaaaggcaaagaagatatccacacaaaattgatgagaagatacaaagacataccttcttggtggtttcattcattgctgctcgtgacacttctggtttctctcgcactatgtatctttctaaaggaccaggttcagatgccctggtggggacttctctttgctggagtgctagcttttggatttacccttcccattagcattatcactgccaccacaaaccagacaccaggattgaatatcatcactgagtatgtctttggtctcatttaccctggaagaccaatagcaaacgtatgtttcaaaacatatggttacattagcatggcgcaagctgtttctttcctcagtgatttcaaacttgggcattacatgaaaatccctccaaggtcaatgttcttagttcagttcataggtacaatgcttgctggaaccattaacattggggtagcatggtggttgctgaactctatcaagaacatatgtcatgacgatctccttccagaaggcagtccctggacatgcccgggtgaccgtgtattctttgatgcatcagttatttggggtctggtgggaccaaagcgtatctttggttctcaaggaaactacagtgcaatgaattggtttttccttggaggtgcagtaggacccataattgtttggctattgcacaaagcatttcccaaacagtcatggattccactaatcaacctcccagttctattgggagcaactggaatgatgccaccagcaacaccattgaactacaatgcctggattttcgttggaacgattttcaacttctttatcttccgttacagaaagaaatggtggcagaggtacaactatgttctgtcagcagcacttgatagtggggttgcttttatgactgtcttgctctacttcgcactgggtttggaaaacaagagtctaaattggtggggaaatgatggtgaacattgtccactggcagtttgcccaacagcaaagggcgtaatagttgacggttgccctgcaaactagtgattgattttatagtttatacctcttttaatggtttcattacaaataccaagcatgaaaaacacgaatttatagcaaattcaaaatgtataacataaaatcactatatttccaaggaaaaaaaaaaaaaaa

SEQ ID NO: 108 - protein, 736 aa, Glycine max
MSSDPEKRVTSEVVEDDELSPIEEVRLTVTNTDDPTRPVWTFRMWFLGLLSCSLLSFLNQFFAYRTEPLIITQITVQVATLPIGHFMAAFLPTTTFSIPGFGSKSFSFNPGPFNMKEHVLITIFANAGSAFGSGSPYAVGIVNIIKAFYGRSISFAASWLLIITTQVLGYGWAGLLRKYVVEPAHMWWPSTLVQVSLFRALHEKDDHRLSRAKFFFIALVCSFSWYVVPGYLFTTLTNISWVCWIFSKSVTAQQIGSGMRGLGVGALTLDWAAVASFLFSPLISPFFAIVNVFVGYALIVYVVIPVSYWGLNVYNANRFPIFSSHLFTAQGQKYNIPKIVDNHFELNVAEYEKQGRIHLSVFFALTYGFGFATIASTLTHVVCFYGREIMERYRASSKGKEDIHTKLMRRYKDIPSWWFHSLLLVTLLVSLALCIFLKDQVQMPWWGLLFAGVLAFGFTLPISIITATTNQTPGLNIITEYVFGLIYPGRPIANVCFKTYGYISMAQAVSFLSDFKLGHYMKIPPRSMFLVQFIGTMLAGTINIGVAWWLLNSIKNICHDDLLPEGSPWTCPGDRVFFDASVIWGLVGPKRIFGSQGNYSAMNWFFLGGAVGPIIVWLLHKAFPKQSWIPLINLPVLLGATGMMPPATPLNYNAWIFVGTIFNFFIFRYRKKWWQRYNYVLSAALDSGVAFMTVLLYFALGLENKSLNWWGNDGEHCPLAVCPTAKGVIVDGCPAN

SEQ ID NO: 109 - DNA, 2364 bp, Zea mays
  CDS (1)..(2364)
atgccacatcccccgcgagcaactactaccatggcatcctcccctcaacctcctcctcatcctcctcctcgccaggaagaggaccagcaacgggaagaagggcaccaccatggcgacggaggcgacgacgaccagatcaccaccccgctcctggtggaagcggcgacgacgtcgtcgccgtcgccgtcggagggagacgatccagagaactcgccgatcgagcaggtggcgctgacggtgccggtgggcgacgacccgtcgacgccggtgctgacgttccggatgtgggtgctgggcacggcgtcgtgcgcgctgctgtcgttcctgaaccagttcttctggtaccgcaaggagccgctgaccatcacggccatctcggcgcagatcgcggtggtgccgctgggccgcctgatggcggcggcgctccccgcgcgcgccgtgctccgcggcacccgctgggagttctcgctcaacccgggccccttcagcgtcaaggagcacgtcctcatcaccatcttcgccaacgccggcgccggcaccgtctacgccaacaacctcatcaccgccgtccgcgtcttctacggcaagcacatcaccttcctcatcgccctcctcctcatcctcaccacccaggtgatggggttcggctgggcgggaatattccggcggtacctggtggagccggcggcgatgtggtggccctccaacctcgtgcaggtctccctcttcagggcactccacgagaaggagcgaagcagaaaagggagcagcatgacacgcaaccagttcttcatggtggcattcatctgcagcttcgcctactacatcttcccgggctacctgttccagatgctcacctccctctcctggatctgctgggcgttcccgcgctccgtggtggcgcagcagctggggtcggggctgagcgggctgggcgtgggcgcggtggggctcgactggtccaccatctcctcctacctcggaagcccgctcgccagcccctggttcgccaccgccaacgtggccgccggcttcgtcctcatcatgtacgtcatcacgcccgccgcgtactactggctcggcctgtacggggcgcgcagcttccccatcttctccgacgggctcttcaccgccgccgggcagacgtacaacatctccagcatcgtggactccaacttccggttcgacaccgaggcatacgagcgcaacggcccgctctacctcagcaccttcttcgccgtcacctacggggtcggcttcgcgtccctcaccgccacggttgtgcacgtcttcctcttccacgggagcgagatctggcagctgagcaggtcagcgttccaagagaagaaggtggacgtgcacacgaggctgatgaggaggtacaggcaggtccccgagtggtggttcatctgcatcctcgtcgccaacgtcgccgtcaccatattcgcctgcgagtactacatcgagcagctccagctgccctggtggggcgtcctgctcgcctgcgccatcgccttcttcttcaccctcccgatagggatcatcacagcgacgacgaaccagactccaggcctgaacatcatcaccgaatacatcatggggtacctgtacccgggccgtcccgtcgccaacatgtgcttcaaggtgtacggctacatcagcatgacgcaggcgctggccttcctgcaagacttcaagctgggccactacatgaagatcccgccgaggaccatgttcatggcgcaggtggtggggacgctgatcgcggcgctcgtgtacatcgggacggcgtggtggctcatggacagcgtccccaacatctgcagcacggagctgctccccgccgacagcccctggacgtgccccatggaccacgtgttctacgacgcgtccgtcatctggggcctcatcggcccgcgcaggatcttcggcgacctcggcacctactcggcggtcaactggttcttcctgggcggcgccgtcgcgcccctcctcgtgtggctcgcgcaccgggtgttcccgagccagagctggatcctgctcgtcaacatgcccgtgctcatcggctccaccggcatgatgccgccggccaccgccgtcaactacaccacgtggatcattgccgggttcctgtcggggtacgtggtctacaggtaccggcgtcactggtgggagcgccacaactacctgctctctggcgcgctcgacgctggcctggcgttcatggccgtgctcatctacctgtgcttgggcttggagaacgtcggcctcaactggtggggcaatgatctggacgggtgccctctcgcctcttgtcccactgccaaaggtatcgttgttgagggctgcccggtgtatacatga

SEQ ID NO: 110 - protein, 787 aa, Zea mays
MPHPPRATTTMASSPQPPPHPPPRQEEDQQREEGHHHGDGGDDDQITTPLLVEAATTSSPSPSEGDDPENSPIEQVALTVPVGDDPSTPVLTFRMWVLGTASCALLSFLNQFFWYRKEPLTITAISAQIAVVPLGRLMAAALPARAVLRGTRWEFSLNPGPFSVKEHVLITIFANAGAGTVYANNLITAVRVFYGKHITFLIALLLILTTQVMGFGWAGIFRRYLVEPAAMWWPSNLVQVSLFRALHEKERSRKGSSMTRNQFFMVAFICSFAYYIFPGYLFQMLTSLSWICWAFPRSVVAQQLGSGLSGLGVGAVGLDWSTISSYLGSPLASPWFATANVAAGFVLIMYVITPAAYYWLGLYGARSFPIFSDGLFTAAGQTYNISSIVDSNFRFDTEAYERNGPLYLSTFFAVTYGVGFASLTATVVHVFLFHGSEIWQLSRSAFQEKKVDVHTRLMRRYRQVPEWWFICILVANVAVTIFACEYYIEQLQLPWWGVLLACAIAFFFTLPIGIITATTNQTPGLNIITEYIMGYLYPGRPVANMCFKVYGYISMTQALAFLQDFKLGHYMKIPPRTMFMAQVVGTLIAALVYIGTAWWLMDSVPNICSTELLPADSPWTCPMDHVFYDASVIWGLIGPRRIFGDLGTYSAVNWFFLGGAVAPLLVWLAHRVFPSQSWILLVNMPVLIGSTGMMPPATAVNYTTWIIAGFLSGYVVYRYRRHWWERHNYLLSGALDAGLAFMAVLIYLCLGLENVGLNWWGNDLDGCPLASCPTAKGIVVEGCPVYT

SEQ ID NO: 111 - DNA, 2247 bp, Zea mays
  CDS (1)..(2247)
atggcgtcgcggaagtcgccggtggcggcggaggagcgggcggggacggggacgggggaggggaagggggagcggtgcgcggtggaggaggtggcgctggtggtgccggagacggacgacccgtcgatgcccgtgatgacattccgggcgtgggcgctggggctcggctcctgcgtcgtcctcatcttcctcaacaccttcttcacgtaccgcacccagccgctcaccatctcggggatcctggcgcagatcctcgtgctccccgcaggccgcttcctggccgccgtgctgcccgaccgcgaggtcaggatcctcggcggcaggctcggcagcttcaacctcaacccggggcccttcaacgtcaaggagcacgtcatcatcaccatcttcgccaactgcggcgtctcctacggcggcggcgacgcttactccatcggcgccatcaccgtcatgaaggcctactacaagcagacgctcagcttcgcatgcgccctcctcatcgtcctcaccacacagatactggggtacggctgggctgggttgctgaggaggtacctggtcgaccctgccgagatgtggtggccttctaaccttgcccaggtctcactcttcagggcgctgcacgagaaagaagaggagggcggcaagtcccgtggcccgtcgcggatgcgcttcttcctcatcgtcttcttcgcgagcttcgcgtactacgcgctgccggggtacctgctgccgatcctgaccttcttctcgtgggcgtgctgggcgtggccgcacagcatcacggcgcagcaggtcgggtccgggtaccacggcctcggcgtcggcgcattcacgctcgactgggcgggcatctcggcgtaccacggcagcccgctggtggcgccgtgggcgtccatcgccaacacggccgtgggattcgtcatgttcatctacgtcatcgtgccgctctgctactggcagttcaacacgttcgacgcccgcaggttccccatcttctccaaccagctcttcacggcgtcgggccagaagtacgacaccaccaaggtgctcaccaaggacttcgacctcaacgtcgccgcctacgacagctacgggaagctctacctcagcccgctcttcgccatctccatcggctccggcttcctgcggttcacggccaccatcgtccacgtcctgctcttccatggcagcgacatgtggaagcagagcaagtcggccatgaacgcggtgaagctggacgtgcacgccaagctgatgcagaggtacaggcaggtgccgcagtggtggttcctcatgctgctgctgggcagcgtggtggtgtccctgctcatgtccttcgtctggaaggaggagatgcagctgccgtggtgggggatgctcttcgccttcgcgctcgccttcgtcgtcaccctccccatcggcgtcatccaggccaccactaaccagcaaccggggtacgacatcatcgcgcagttcatgatcggctacgcgctgcccggcaagcccatcgccaacctgctcttcaagatctacggccggatcagcaccgtgcacgcgctatcgttcctcgcagacctcaagctcggccactacatgaagatccccccaaggtgcatgtacacggcccagctggtcgggacggtggtcgccggcgtggtgaacctggcggtggcgtggtggatgctggacaacatcgagaacatctgcgacgtggaggcgctgcacccggacagcccgtggacgtgccccaagtaccgcgtcacgttcgacgcgtcggtgatctggggcctgatcggcccggggcggctcttcggccagcacgggctgtaccgcaacctggtgtggctgttcctggtcggcgcggtgctccccgtgccggtgtggctgctgagcagggcgttcccggagaagaagtggatcgcgctcatcaacgtgcccgtcatctcgtacgggttcgccgggatgccgccggccacgcccaccaacatcgccacctggctggtgacgggcaccatcttcaactacttcgtcttcaggtaccgcaaggggtggtggcagaagtacaactacgtgctctcggccgcgctcgacgccggcaccgccttcatgggggtgctcatcttcttcgccctccagaacgcgcaccacgagctcaagtggtggggcacggaggtggatcattgcccgctcgcctcctgccccaccgcgccgggcatcgccgtcaagggctgcccggtgttctga

SEQ ID NO: 112 - protein, 748 aa, Zea mays
MASRKSPVAAEERAGTGTGEGKGERCAVEEVALVVPETDDPSMPVMTFRAWALGLGSCVVLIFLNTFFTYRTQPLTISGILAQILVLPAGRFLAAVLPDREVRILGGRLGSFNLNPGPFNVKEHVIITIFANCGVSYGGGDAYSIGAITVMKAYYKQTLSFACALLIVLTTQILGYGWAGLLRRYLVDPAEMWWPSNLAQVSLFRALHEKEEEGGKSRGPSRMRFFLIVFFASFAYYALPGYLLPILTFFSWACWAWPHSITAQQVGSGYHGLGVGAFTLDWAGISAYHGSPLVAPWASIANTAVGFVMFIYVIVPLCYWQFNTFDARRFPIFSNQLFTASGQKYDTTKVLTKDFDLNVAAYDSYGKLYLSPLFAISIGSGFLRFTATIVHVLLFHGSDMWKQSKSAMNAVKLDVHAKLMQRYRQVPQWWFLMLLLGSVVVSLLMSFVWKEEMQLPWWGMLFAFALAFVVTLPIGVIQATTNQQPGYDIIAQFMIGYALPGKPIANLLFKIYGRISTVHALSFLADLKLGHYMKIPPRCMYTAQLVGTVVAGVVNLAVAWWMLDNIENICDVEALHPDSPWTCPKYRVTFDASVIWGLIGPGRLFGQHGLYRNLVWLFLVGAVLPVPVWLLSRAFPEKKWIALINVPVISYGFAGMPPATPTNIATWLVTGTIFNYFVFRYRKGWWQKYNYVLSAALDAGTAFMGVLIFFALQNAHHELKWWGTEVDHCPLASCPTAPGIAVKGCPVF

SEQ ID NO: 113 - DNA, 987 bp, Arabidopsis thaliana
  CDS (1)..(987)
atggcggtgacggaggaggagaagaagcggaattcaacggttgagatctccggattacgtttcacgtatcctggaatcgacggtcatccaccaccgggatcgaaaccacttattgaagatttctcaatcacgcttaattccagcgatcggtgtctcctcgtcggatctaatggcgctgggaaaacgacgattctgaagatattgggagggaaacacatggtggagccgcatatggttagggttctgggtcgctcggcgtttcatgatactggattgacctcttctggtgatctctgttatctcggtggcgagtggaggcgtgatgttgcatttgcaggatttgaagttccgatacaaatggacatttcggcggagaagatgatatttggagtggctggtattgatcctcagagaagagatgagttgatcaaggtgttggatatcgacatctcatggagactgcacaaggtatccgatggccaaagaagacgtgtacagatctgtatgggactcctgaagccattcaaggttctccttttggatgaaataactgttgatcttgacgttctcgctagagcagaccttttgaagtttctgagaaaggaatgtgaagaacgaggagcaaccataatctacgctactcatatattcgatggcttagaggactggccaacacacattgtgtatgtagcaaacggaaaattgcagttagcattgccaatggagaaagtgaaggagacaagcaagaagtcattgatgagaacagttgagagttggctgaggaaagaaagagatgaagagagaaagagaaggaaagagaggaaagctaatgggcttccagagtttgaaacacggactgaagaaagccgtgtgactggtgatccagcacggatgctgaacaatggctgggctgccgggagacttcactctacggttgcaggtggtgaggataatttcgtcttaagctcaaacagagttctaagataa

SEQ ID NO: 114 - protein, 328 aa, Arabidopsis thaliana
MAVTEEEKKRNSTVEISGLRFTYPGIDGHPPPGSKPLIEDFSITLNSSDRCLLVGSNGAGKTTILKILGGKHMVEPHMVRVLGRSAFHDTGLTSSGDLCYLGGEWRRDVAFAGFEVPIQMDISAEKMIFGVAGIDPQRRDELIKVLDIDISWRLHKVSDGQRRRVQICMGLLKPFKVLLLDEITVDLDVLARADLLKFLRKECEERGATIIYATHIFDGLEDWPTHIVYVANGKLQLALPMEKVKETSKKSLMRTVESWLRKERDEERKRRKERKANGLPEFETRTEESRVTGDPARMLNNGWAAGRLHSTVAGGEDNFVLSSNRVLR

SEQ ID NO: 115 - DNA, 747 bp, Archaeoglobus fulgidus
  Archaeoglobus fulgidus DSM 4304
  CDS (1)..(747): transl_table=11
atgattgaagtcaggagcttatactactcctacaactccaaacccgttattcaggatttggagtttgaggctgagaggggcgaattcgttttcattctcggccccaatgggagcggaaagacaactctgctgaagtgcatggccggcattctgaaaccaaagggagcggtgctcgttgaaaaggttagcattgataggctttcggggagagatctggccagaaagcttgcttacgtcccccaaagaagcgattcaggatttttaactgtttatgatgtcgttctgcttggcagaaggccctacatgggcttttcaccatccgatgaggattacaggattgtggaggacgtgctttcgctgctcgacctcaagaagttctcctacagaagaatcaacgagctaagcggtggagagcttcagaaagtaatgattgccagagccttagcccagaaaccgaaaatactccttctggacgagcccacgaacaaccttgacgtgaagaaccagattgagataatgaagcttcttcggaaaatagccgacgagaaggagatttcagttatatccaccatgcacgacttgaatcttgctgccatcttcgcagacaaaatagtaatgctgaaaaacggcaggatattcgcttcaggcggtaaggaggttcttacgcaggagaacataaaggaggtttacggcatagaggtggaagttctcaggcacaacgggagggttcttattgtcccgcagtga

SEQ ID NO: 116 - protein, 248 aa, Archaeoglobus fulgidus
  Archaeoglobus fulgidus DSM 4304
MIEVRSLYYSYNSKPVIQDLEFEAERGEFVFILGPNGSGKTTLLKCMAGILKPKGAVLVEKVSIDRLSGRDLARKLAYVPQRSDSGFLTVYDVVLLGRRPYMGFSPSDEDYRIVEDVLSLLDLKKFSYRRINELSGGELQKVMIARALAQKPKILLLDEPTNNLDVKNQIEIMKLLRKIADEKEISVISTMHDLNLAAIFADKIVMLKNGRIFASGGKEVLTQENIKEVYGIEVEVLRHNGRVLIVPQ

SEQ ID NO: 117 - DNA, 1020 bp, Thermoplasma volcanium
  Thermoplasma volcanium GSS1
  CDS (1)..(1020): transl_table=11
atgaactcatttccaagtggagcggtgaaaatgccgataataaaaactgagaacctaactaaaatttattcggggaacataaaggccgtatcggatctaaacatagagattgaagaagccgagatatacggtctgctaggcaaaaatggggcaggcaaaacgactacaataaaaatgttgactacagctatagaacccacctccggcaatgcaaaagttgctggttacgaccttttgaaagatcgcgaaaaaataaggaatataatcggtgtagtcccgcaggacttgaccaccgacgctgatctaaagggaatagaaaatctaagaatgatagcggcgttctacgatataccaaagtctgtagctgaatcaaggataaacgatctcctcaacatagttgatttgactgattggggaaataagtatgtatcgcagtactcaggcggaatgagaaagaggcttgagctaatatgcggcctggtaaatgccccaaagatcctgttcctagatgagccaacgcttggtctcgatgtaaataccagggcgaagatgtggaaatatataagggacatacaaaaggagcttggagtaacgataatattgacgtcgcactaccttgaggaggttgacgagctcgcaaacaggatctcaataattgatcacggcaagatactcgttactggtacgccggatgaactaaaatcaagcctcaagggagacattataactatgcagttttcaggatcagatgaagccgaggcggcccgctattatccaaacgccttatattcttctatttctggagaagacaaggtgagaataaaagttgaaaactctgacgtagagctaccaaaaatactctcttatctaacgcagaaaggcatatccccgttgacaataaacgttaagaagccctcgcttgacgaagtatttcttgagtacactgggagctcaattgatgaggatataggcccggaacagttcagaaggatgatgcagaacgtaaggaggttgaggtag

SEQ ID NO: 118 - protein, 339 aa, Thermoplasma volcanium
  Thermoplasma volcanium GSS1
MNSFPSGAVKMPIIKTENLTKIYSGNIKAVSDLNIEIEEAEIYGLLGKNGAGKTTTIKMLTTAIEPTSGNAKVAGYDLLKDREKIRNIIGVVPQDLTTDADLKGIENLRMIAAFYDIPKSVAESRINDLLNIVDLTDWGNKYVSQYSGGMRKRLELICGLVNAPKILFLDEPTLGLDVNTRAKMWKYIRDIQKELGVTIILTSHYLEEVDELANRISIIDHGKILVTGTPDELKSSLKGDIITMQFSGSDEAEAARYYPNALYSSISGEDKVRIKVENSDVELPKILSYLTQKGISPLTINVKKPSLDEVFLEYTGSSIDEDIGPEQFRRMMQNVRRLR

SEQ ID NO: 119 - DNA, 972 bp, Aeropyrum pernix
  Aeropyrum pernix K1
  CDS (1)..(972): transl_table=11
gtgggttacgcggtagaagcggaggctctagtgaaggagtacaggatgggcttgctcccatggagggctaggactatcagagccttagacggtgtcgatcttaaagtcggtagggggaccctcttctcgctgctgggccctaacggtgctggcaagacgactctcgttaagatactctccacactcctccttcccgactcgggctgggccagggtcgccgggttcgacgtcgttagggaggctaacaatgtgaggagcaggataggggttgtgctgggaggggagagggctctctactggaggctctcgggctgggataacctatggttcttcagccagctctacggcatacccccgagggaggctaagaggagagttaaggagcttctcgagattgttggcctcgaggagtgggctcacgtgagggttgaaaactactccaaggggatgaaacagaggctccatatagcgcgggggcttataaacgatccggaggtgcttctactagacgagcccactataggcctagaccccaaggccgccagggaggttagaagcattatacggaggatagttcgggaagggaggactgtcctgctgacgacgcactacatggtagaggcggaggagctgtcagacagggtggctataataagcaagggtaggatagtggctgagggcccgcctgaggacctcaagtcgctagtcggcggcgagagcgttattgaactgaaagtgatggggggagacagggttagtatgttgctggaaagactcggaggtagggtaattagcgtagtagagcgtgacggggccagagtttttagggtgcttgtctccgagcccgactcgttcatagaagctctgttggcagagctcacgcgcataaacgccagtatccgggggctagatgtgaggagcccgagcctcgaggacgtgtttataaagctagctgggggagaaggcgggtga

SEQ ID NO: 120 - protein, 323 aa, Aeropyrum pernix
  Aeropyrum pernix K1
MGYAVEAEALVKEYRMGLLPWRARTIRALDGVDLKVGRGTLFSLLGPNGAGKTTLVKILSTLLLPDSGWARVAGFDVVREANNVRSRIGVVLGGERALYWRLSGWDNLWFFSQLYGIPPREAKRRVKELLEIVGLEEWAHVRVENYSKGMKQRLHIARGLINDPEVLLLDEPTIGLDPKAAREVRSIIRRIVREGRTVLLTTHYMVEAEELSDRVAIISKGRIVAEGPPEDLKSLVGGESVIELKVMGGDRVSMLLERLGGRVISVVERDGARVFRVLVSEPDSFIEALLAELTRINASIRGLDVRSPSLEDVFIKLAGGEGG

SEQ ID NO: 121 - DNA, 849 bp, Arabidopsis thaliana
  CDS (1)..(849)
atggcggagaaaaatgcgagcgcggtggacggtgcaattagggttagtggaatgcagttttcttacgatgttcaagatcctattttcttcgattttaatctcgatcttcccgctggatctcgttgcctcttggttggtgccaatggatctgggaaaactacgttattgaagattcttgctggaaaacatatggttggaggaaagaatgttgtacaagtgcttgatcgctcagcatttcatgatacagagcttgtttgtagtggtgatttgtcttacctaggaggatcatggagtaaaactgctggttctgctggtgatattccactccaaggagacttctcagcagaacatatgatatttggagttgaagggattgatcctttcagaagagagaagttgattgatcttcttgatatcaatcttcaatggcgtatgcataaggtttctgatgggcagagacgtcgagtgcaaatatgtatgggtctattacatccgttcaaggtattactactggatgaagttactgttgacctcgacgttgttgctaggatggatttgttggagttctttaaagaagaatgtgaacagagaggagctacaattgtatatgcaactcatattttcgacgggctcgagacatgggctagtcatttggcttacattaatggaggagagctgaaactctcggccaagttagatgagatcaaggatctcaaaacctcaccaaatctgctatctgttgttgaagcttggctccggtctgaaaccaaagttgagaaaaagacgaagaagaaacctgttgttacctctccatttatgtcgtctagacaaatggcatattaccgatga

SEQ ID NO: 122 - protein, 282 aa, Arabidopsis thaliana
MAEKNASAVDGAIRVSGMQFSYDVQDPIFFDFNLDLPAGSRCLLVGANGSGKTTLLKILAGKHMVGGKNVVQVLDRSAFHDTELVCSGDLSYLGGSWSKTAGSAGDIPLQGDFSAEHMIFGVEGIDPFRREKLIDLLDINLQWRMHKVSDGQRRRVQICMGLLHPFKVLLLDEVTVDLDVVARMDLLEFFKEECEQRGATIVYATHIFDGLETWASHLAYINGGELKLSAKLDEIKDLKTSPNLLSVVEAWLRSETKVEKKTKKKPVVTSPFMSSRQMAYYR

SEQ ID NO: 123 - DNA, 882 bp, Thermotoga maritima
  Thermotoga maritima MSB8
  CDS (1)..(882): transl_table=11
gtgtcggtagttgaggtgagagatctcaccaagtactacggaaagtccagaggagtggaaggtgtaactttctcagttgaagaaggagagatattcggcttcatcggaccgaacggtgcggggaagacaactaccataaggcttctcctcggtttgatctttccggattctggtctggcagagatttttgggaaagacgtcctgaaagaaggaaaagaaatcagaaagaacgttggctacattccaggtgaggtgagcttttacccggaagtgactgtggaggaatttctcaggtactccgccagtttctatgaaaaggtagactgggattatgtgaaggaactctgcggtgttttttcgctcgacacgaaaaaacgtatcaaggaactctccatgggaaacaaaaagaaagtggctatcgttcaggctttgatgcacagaccgaaacttctcatcctggacgagcccacgaatggcctcgatcctatcgttcaaaacaccttctttgaaattttaaaaaacgagaaagaaaaaggtacgaccgtgttcttttcctcgcacatattaagtgaggtagaaagactttgcgatcgcgttgcgatgataaaggatgggagaatcatcagggtggaaaaggtggagaatctcaaaggggaaagatacaaggtggtccgtgtcaaaggtgaaaatctggaaaaactgaaagatctggctgaagtgaatcgactgaagtttgaaaacggcacggcggagtttctcttttcaggaaacgttgaaagactcctcgaaattcttcgaagtttgaaactgtccgatttctgggtggaagaaccttctcttgaagagatattcatgtcctactatcgggagggagaagaatga

SEQ ID NO: 124 - protein, 293 aa, Thermotoga maritima
  Thermotoga maritima MSB8
MSVVEVRDLTKYYGKSRGVEGVTFSVEEGEIFGFIGPNGAGKTTTIRLLLGLIFPDSGLAEIFGKDVLKEGKEIRKNVGYIPGEVSFYPEVTVEEFLRYSASFYEKVDWDYVKELCGVFSLDTKKRIKELSMGNKKKVAIVQALMHRPKLLILDEPTNGLDPIVQNTFFEILKNEKEKGTTVFFSSHILSEVERLCDRVAMIKDGRIIRVEKVENLKGERYKVVRVKGENLEKLKDLAEVNRLKFENGTAEFLFSGNVERLLEILRSLKLSDFWVEEPSLEEIFMSYYREGEE

SEQ ID NO: 125 - DNA, 861 bp, Sulfolobus solfataricus
  Sulfolobus solfataricus P2
  CDS (1)..(861): transl_table=11
atgactattgaagttgaggatttaaggaaaaagtttgctggtaaagaagtacttaagggcgttagttttaaactcagaagtggatcaataactggttttattggaccaaatggtgctggaaaaacgactacaataaaaatactttctgggttgttaagaaaggacggagggtttgttaaagtatttggtgaagatccttgggataacccaaaggtcatggagagaatttcagttattttcactaacttaattcatcctcaagagaacacagtaggggaatatttgatggatctgggaaatgtttatgggaaaaagagggagataattaactatctaattgaggaatttaagttaactcctcaccttaataagaggctttatcaactatcctctggtttagcccaaagagttcaattagtagctgcattaataaaggatgttgagttgataatagcagacgaacccactgccaatctagatccctcctttagaatagagttttatgaggtagtgaaggagttgaataggaaaaatggtgtaacgtttttcatttcatctcatatactctcagagctcgaaaaagttataactgatgtaatatttattaatgacggaagaattacatactcaggcaggatgaacaaggctttaagcgataccgaagaggaagaaatttacgtaatggtagacgatactgatagagctttgaaattattgggaggaatacttgaaggaccttatataaaggttaaaggtaagttaagggagatagtagataagttagatgataatggaatcgagataataagtattaggaggttctcactagatgatgccttcaagaagttttcaaatatttag

SEQ ID NO: 126 - protein, 286 aa, Sulfolobus solfataricus
  Sulfolobus solfataricus P2
MTIEVEDLRKKFAGKEVLKGVSFKLRSGSITGFIGPNGAGKTTTIKILSGLLRKDGGFVKVFGEDPWDNPKVMERISVIFTNLIHPQENTVGEYLMDLGNVYGKKREIINYLIEEFKLTPHLNKRLYQLSSGLAQRVQLVAALIKDVELIIADEPTANLDPSFRIEFYEVVKELNRKNGVTFFISSHILSELEKVITDVIFINDGRITYSGRMNKALSDTEEEEIYVMVDDTDRALKLLGGILEGPYIKVKGKLREIVDKLDDNGIEIISIRRFSLDDAFKKFSNI

SEQ ID NO: 127 - DNA, 864 bp, Sulfolobus tokodaii
  Sulfolobus tokodaii str. 7
  CDS (1)..(864): transl_table=11
gtgcatgctatcgaactatataacgtttataaaagttacaacaataaacctgttttacgaaacatcacatttactgttcctcaaagctctataactggatttattggtcccaacggctctggaaaaactactacgataaagatcttatctggattaattagaaaagataaaggagttattagagttcttgaagaagatccgtgggataatcctaagttaaaaagaaaagtatcggttatttttacaaaattaccttatcctcctaatgatacagtagaagagtacttgagtgacctaaactctatatttaagggagatttaagtaaacttataaaggagtttaatttaagcgaacatttaaagaaaaagatttctcaactttcttctggtcaagcgcaaaagattcaattaattgcggctctattaaaaaatccagagttaattattgctgatgaacctacagctaatttagatccacaagctagattagaattctatgagttagtaaggtttatggttaaggagtataatgtaactttctttatttcatctcatatactttctgaattagagaaagtaattacacacattgtatttatcaataatggagtaataacagcaacaggagagataaacgatattgaagcaaaaatttcctctaacgaaatcttgttactagtaagggagaaagagaaagctttaaaaattttggcaaagtataacccgactcttgatggagcttatataaaagtaaaaggaaacttgagggaaatagtggatttattagatgatggaaaaatagaaattttaagtataagaaaagcgagtcttgatgatgtttttagaaagctaagtggtgtttaa

SEQ ID NO: 128 - protein, 287 aa, Sulfolobus tokodaii
  Sulfolobus tokodaii str. 7
MHAIELYNVYKSYNNKPVLRNITFTVPQSSITGFIGPNGSGKTTTIKILSGLIRKDKGVIRVLEEDPWDNPKLKRKVSVIFTKLPYPPNDTVEEYLSDLNSIFKGDLSKLIKEFNLSEHLKKKISQLSSGQAQKIQLIAALLKNPELIIADEPTANLDPQARLEFYELVRFMVKEYNVTFFISSHILSELEKVITHIVFINNGVITATGEINDIEAKISSNEILLLVREKEKALKILAKYNPTLDGAYIKVKGNLREIVDLLDDGKIEILSIRKASLDDVFRKLSGV

SEQ ID NO: 129 - DNA, 738 bp, Synechocystis sp.
  Synechocystis sp. PCC 6803
  CDS (1)..(738): transl_table=11
atggcaatgcttctttcctccccctccagtgacctagtcaccatgacaccagcggaaccagtggtggccatggaaaatctcagtcatttctacggcactggcaatctccgcaaacaaattttatttgatatcaatctccgattggacgaaggggaggtggtgatcctcaaggggccttccggttcgggaaaaacaacattgttgaccctgatgggggggttacggtcggcccagagcggtagtttgcgggtgtttggtcaagagttaaatggagcaaaaaaacaggatttggttcaggtccgccgtcacattggctatattttccaagcccacaatttgctcgaatccctcactgctaggcaaaatgtacagatggccatcgaactacacccccaatacaatgctcaacaggcgaaagagttgtccattgccatgctggaggcggtgggactaggagctcacattaactacaatccccacaatctttccggtggacaaaaacaacgggtggcgatcgccagggcattagtaagtcatcccaaaatgattttggccgatgaaccaacggcggccttggacagtaaatcgggccatgacgtggtggagttgatgcgaaaattagcccgagagcaggggtctactattttgattgtcacccatgacaaccgcattttggacgtggcagacaggattattcaactcgaagatgggcaactttgtgccgacccaggggagtga

SEQ ID NO: 130 - protein, 245 aa, Synechocystis sp.
  Synechocystis sp. PCC 6803
MAMLLSSPSSDLVTMTPAEPVVAMENLSHFYGTGNLRKQILFDINLRLDEGEVVILKGPSGSGKTTLLTLMGGLRSAQSGSLRVFGQELNGAKKQDLVQVRRHIGYIFQAHNLLESLTARQNVQMAIELHPQYNAQQAKELSIAMLEAVGLGAHINYNPHNLSGGQKQRVAIARALVSHPKMILADEPTAALDSKSGHDVVELMRKLAREQGSTILIVTHDNRILDVADRIIQLEDGQLCADPGE

SEQ ID NO: 131 - DNA, 873 bp, Arabidopsis thaliana
  CDS (1)..(873)
atggcggagaaagatgcgacggcgagtggcgatgacgccattagagttagcggtatgcaattcgcatacgaagttgaggatccaatattcttcgacttcaacctcgatcttccagctggttctcgctgtcttctggttggtgccaatggatctggcaagacaaccttattgaagattctggctggaaagcatatggtgggaggaaagaacgttgtacaagttcttagccgctcggctttccatgatactcaacttgtttgcagtggtgacttgtcttaccttggaggatcatggagtaaaaccgttggttcagctggagaggttcctctccagggagatttctcagcagaacatatgatatttggagttgaaggaactgatcccgtgagaagagaaaaactgattgatcttcttgatatcaatcttcaatggcgtatgcataaggtttctgatgggcagaaacggcgcgtgcagatatgtatgggactcttacatccattcaaggtgttattactcgatgaggtcactgttgacctagacgtcgttgcaaggatggatttgctggaattcttcaaagaagaatgtgatcagagaggagctacaatcgtgtatgcaactcacatattcgacgggctagagacatgggcgacacatttggcctacattcaggacggtgagctgaatcgtttatcgaaaatgacagatattgaggagctgaaaacttcacccaacctcctctccgtggtagaatcttggctccgttctgaaatcaaactcgtgaagaagaagaagaagcctgtggcgccatggaaaccatctccattcgataactctccttttagatcatcgagacacatggcttattaccgatga

SEQ ID NO: 132 - protein, 290 aa, Arabidopsis thaliana
MAEKDATASGDDAIRVSGMQFAYEVEDPIFFDFNLDLPAGSRCLLVGANGSGKTTLLKILAGKHMVGGKNVVQVLSRSAFHDTQLVCSGDLSYLGGSWSKTVGSAGEVPLQGDFSAEHMIFGVEGTDPVRREKLIDLLDINLQWRMHKVSDGQKRRVQICMGLLHPFKVLLLDEVTVDLDVVARMDLLEFFKEECDQRGATIVYATHIFDGLETWATHLAYIQDGELNRLSKMTDIEELKTSPNLLSVVESWLRSEIKLVKKKKKPVAPWKPSPFDNSPFRSSRHMAYYR

SEQ ID NO: 133 - DNA, 885 bp, Pyrococcus furiosus
  Pyrococcus furiosus DSM 3638
  CDS (1)..(885): transl_table=11
atgatcattgcacttgagataaaaggtcttaaaaagcgctatggtaacgttgaggctctaaagggaattactcttgaagtctatgaaggagagatatttgcccttcttggccctaatggggctggaaaaacaacacttataagaattctggcagagggattgaaatatgatgaaggtgaaattaaggtgtttggaaggactctttcaagggagacaaggcggttaataggttatgtaccccaggaaagcatagcctatgatcttctaactgtaaaggaaaaccttgagttctatgctgacatatacaacgctcctcgtgagaggataaaagagcttatcgaacttttctctctaccagagaaaaagaaagcgaaggagttgagtggtggattcaagagacgcttaaacttagcaattgctctcttatatgatcctaagattctaatcctagatgagccaacaacgggactagatgtgccttcaaggagagatttctgggaaatcattcgagggttcaaaaaggatggaaagactgttcttcttgccactcactacatggaggaggcagaagagcttgctgacagagttgccataatgaatgaggggaaagtaatttccattggaacgcccgaagagctgaagaggcttattggtgaggaaagcataataacgattaaaggtctcctaaaaggtttggaagagataagttatccctttattgaaaaagataacgagataagagttcgagttaggaatccaagagaagctttgcctaaaatagttgagaatcttattaaagctggaagtattataaaggaaattcgagttgaggagccaacacttgaagatgtttttataaagctgactgggaggaggttagaatga

SEQ ID NO: 134 - protein, 294 aa, Pyrococcus furiosus
  Pyrococcus furiosus DSM 3638
MIIALEIKGLKKRYGNVEALKGITLEVYEGEIFALLGPNGAGKTTLIRILAEGLKYDEGEIKVFGRTLSRETRRLIGYVPQESIAYDLLTVKENLEFYADIYNAPRERIKELIELFSLPEKKKAKELSGGFKRRLNLAIALLYDPKILILDEPTTGLDVPSRRDFWEIIRGFKKDGKTVLLATHYMEEAEELADRVAIMNEGKVISIGTPEELKRLIGEESIITIKGLLKGLEEISYPFIEKDNEIRVRVRNPREALPKIVENLIKAGSIIKEIRVEEPTLEDVFIKLTGRRLE

SEQ ID NO: 135 - DNA, 843 bp, Schizosaccharomyces pombe
  Schizosaccharomyces pombe 972h-
  CDS (1)..(843)
atggaagtaactgtttcaaacctctcttacacgttttctccaaagcagcctttaagtcttgatcacgtaactttagatcttcctaaaggatcaaggactttacttgttggagccaatggagctggaaaatcaactttacttaaacttttatctggaaaatcgcttgcgaaagcaggacatatatcggtgggtggtaaagatccttttcgtgagtctagttctgcatttgtttatttaggaactgaatgggttaacaaccctgttatacatagggatatgagtgttgcacgattaattgcttctgttggaggagataaatttgccgaacgtagggatttcttgatttcaattcttgatatagatcttcgttggcgaatgcatgcagtgtccgatggtgaaagacgacgtgttcaactatgtatgggacttctgcgtccatttgaagtacttttacttgatgaagtaactgtagatttggatgttcttgcccgggcagatttgttaaattttttgcaagaggaaacggaagtaaggaatgctactattgtttatgcaacacatatatttgatggtttagctgagtggccaactcacttggtccatctcagtcttgggcgtatcgtggattatggaccaatatccaagtttggtgctctgatgacaaggtcctctacgggaaatagcgcccttctagagacatgtttggaatggctcaaagaagacaaaaaaaataggggaactcgagaagaggaaaagcgtagtacctgggacgacgttcaagaatcattaaaagttggaactgatgtatttactgattactttaagatttcccgagcaaaatag

SEQ ID NO: 136 - protein, 280 aa, Schizosaccharomyces pombe
  Schizosaccharomyces pombe 972h-
MEVTVSNLSYTFSPKQPLSLDHVTLDLPKGSRTLLVGANGAGKSTLLKLLSGKSLAKAGHISVGGKDPFRESSSAFVYLGTEWVNNPVIHRDMSVARLIASVGGDKFAERRDFLISILDIDLRWRMHAVSDGERRRVQLCMGLLRPFEVLLLDEVTVDLDVLARADLLNFLQEETEVRNATIVYATHIFDGLAEWPTHLVHLSLGRIVDYGPISKFGALMTRSSTGNSALLETCLEWLKEDKKNRGTREEEKRSTWDDVQESLKVGTDVFTDYFKISRAK

SEQ ID NO: 137 - DNA, 774 bp, Thermoanaerobacter tengcongensis
  Thermoanaerobacter tengcongensis MB4
  CDS (1)..(774): transl_table=11
atgagttatatcgaggttaaaaatgtaaattttgcttacgatggaaggcaggtccttcgcaacgtctctttaaaaattgaaaaaggcgagtttgtagggattattggtcctaacggctcagggaaaagtaccctagtaaaagtaatggtaggcaatctcgtgccttccactggggaagtcctgtatgaaggtgtaaacctccagaacataaaggaccgctcctttataagctaccttccccagcgttctttttcctttaactcttcttttccggcaagcgtagaggaagttgtgtctatgggcctttacgccaggaaagggttatttaaaaggctttcaaaggaagactgggaaaaagtgtatgaagccttaaaaatagtggacatgtttgaatttagaagccgcttaattgggagactttcaggaggacagcttcagagggttttcatagcaaggtccatagtatctgagccgcagatactttttctagacgaacccacaacaggaattgacgctaaatcagaaaaggctctttacgagcttttggaaaagctcaacaaagaaagaggaataacaattgtcatggtgactcacgacatcatggctataacaaacaaggcccacagaatcatatgtatgactgacggcaaaataaacgaaaaatgcgaagctatcgatatagaaaagcacgactttacttctttcctctacgaatatcctgtgaagaaagtaaagcatcagcataataataatgggagtgtagaacatgtttga

SEQ ID NO: 138 - protein, 257 aa, Thermoanaerobacter tengcongensis
  Thermoanaerobacter tengcongensis MB4
MSYIEVKNVNFAYDGRQVLRNVSLKIEKGEFVGIIGPNGSGKSTLVKVMVGNLVPSTGEVLYEGVNLQNIKDRSFISYLPQRSFSFNSSFPASVEEVVSMGLYARKGLFKRLSKEDWEKVYEALKIVDMFEFRSRLIGRLSGGQLQRVFIARSIVSEPQILFLDEPTTGIDAKSEKALYELLEKLNKERGITIVMVTHDIMAITNKAHRIICMTDGKINEKCEAIDIEKHDFTSFLYEYPVKKVKHQHNNNGSVEHV

SEQ ID NO: 139 - DNA, 945 bp, Xanthomonas axonopodis
  Xanthomonas axonopodis pv. citri str. 306
  CDS (1)..(945): transl_table=11
atgacttcgatcgtttccatccagggcttgagcaagacctatgccggcggtttccaggcgctcaaacaggtggatcttgagatccggcgtggcgagatcttcgcgctgctcggccccaacggcgccggcaagaccaccttgatcagcatcatctgcggcttgatcaaccccagcaccggcagtgtgctggccgacgggcacgacatcgtgcgcgactaccgcgccgcgcgtgccagcatcggcctggtgccgcaggaactggccaccgatgcgttcgaaacggtgtgggccacggtacgtttcagtcgcgggctgttcggcaagccggccaatccgcaatatctggaaaccatcctgcgcgagctgtcgctgtgggagaaacgcaacaacaagatttccacgctctccggcggcatgaagcggcgtgtgctgatcgccaaggcgctcgcccacgagccgcgcatcctgttcctggacgagcccacggccggtgtggacgtggagctgcgtcacgacatgtggcagatggtgcggcggctgcgcgagcatggcaccaccatcatcctgaccacccattacatcgaagaggccgaagacatggccgaccgcgtcggtgtcatcaatcgcggcgagctggtattggtggaagacaagcgcacgctgatgcgcaagctgggcaagaagcagctcacgctgagcctgcaggcgccgttgcaggcgctgcccgccgcgctggccgatctgccgctggagctggcggccgacggcagtaacctgatctataccttcgacacccaggccgagcagaccggcatcggtgccttgctgcgccggctcaacgagcagggcatcgacttcaaggatctgcattccagcgaaagttcgctggaagagatcttcgtcaacctggtgcatggcgcacgtcagcaggaggtgcgcgcatga

SEQ ID NO: 140 - protein, 314 aa, Xanthomonas axonopodis
  Xanthomonas axonopodis pv. citri str. 306
MTSIVSIQGLSKTYAGGFQALKQVDLEIRRGEIFALLGPNGAGKTTLISIICGLINPSTGSVLADGHDIVRDYRAARASIGLVPQELATDAFETVWATVRFSRGLFGKPANPQYLETILRELSLWEKRNNKISTLSGGMKRRVLIAKALAHEPRILFLDEPTAGVDVELRHDMWQMVRRLREHGTTIILTTHYIEEAEDMADRVGVINRGELVLVEDKRTLMRKLGKKQLTLSLQAPLQALPAALADLPLELAADGSNLIYTFDTQAEQTGIGALLRRLNEQGIDFKDLHSSESSLEEIFVNLVHGARQQEVRA

SEQ ID NO: 141 - DNA, 516 bp, Plasmodium falciparum
  Plasmodium falciparum 3D7
  CDS (1)..(516)
atgaacgaaatagtaattaataatttaaattataattactataatggaatacaaagaacacgtattaaggctttacaaaatgtcaacttatgttttgaaaggggtatgaggatattggtttgtggaaaaaatggtgcaggaaaaagtacattattgagtatcatagcaggaaaaaagttgattaaggaaaacgaagtactaatatttaataaacaggcttttcacgacacggacatatctaataaaataggttatgttggagaatggtggagtgaagagtatgccatgaacattagcataaaagatttctgcttcaattatgaatatactaaaagatacaaaaatttattaaaattattcgaactagacgaaaataaaattatatcaaatctttccaaaggtgaaagaaaaaaggttcaaatcatggttaatataattgtgagaaaagatatttatatatttgatgaggctactgaatctctggatttggtatcaaggaaattattactagagtaa

SEQ ID NO: 142 - protein, 171 aa, Plasmodium falciparum
  Plasmodium falciparum 3D7
MNEIVINNLNYNYYNGIQRTRIKALQNVNLCFERGMRILVCGKNGAGKSTLLSIIAGKKLIKENEVLIFNKQAFHDTDISNKIGYVGEWWSEEYAMNISIKDFCFNYEYTKRYKNLLKLFELDENKIISNLSKGERKKVQIMVNIIVRKDIYIFDEATESLDLVSRKLLLE

SEQ ID NO: 143 - DNA, 915 bp, Corynebacterium efficiens
  Corynebacterium efficiens YS-314
  CDS (1)..(915): transl_table=11
atggcgcactcggacacacctgctgtagagacgatcgggctgtcgaagaatttcggttccgtccgtgctctggatgagctcaacctccgggtggaggccggggaggtgcacggtttcctggggcccaacggttccgggaaatcaaccgccatccgggtcctgctcggcatcctgcgttctgatgccggttccgtgaaggtgctcggtaaagacccctggcgtgatgccgtggaactgcatcaccgcctggcctatgttcccggtgatgtggaattgtggcccaatctcaccggtggcgaggccattgacctgttcgcccgactccggggccggttgaatgtgaagcgccgggatgaactcatcgagcgttttgatctcgatcccagcaagaagggtcgcacctattccaaggggaaccgtcagaaggtggcgctgatctcagcgctggcgtcggatgtggaactgctgcttctcgacgaaccgaccagcggtctcgacccactcatggaagcccagtttcaggagctcatccgtgaagagaaggaacggggccacaccgtcctcctatccagtcatatcctcgcgcaggtcgaagcactggcggatcggatctccatcatccgtaagggcaggatcgtggagtcgggcacccttctggatatgcgtcacctcagccacacggtggtcacggtcctgacggaccgccccaccgcggagctgatcacacatgagggtatctacaatgcccaccgggagggtgagcaggtgcgtttcgacgtcgatgccgcccacctcccggaggtgatgagcatgctcgctgcgctgggggtgcgtgccatcaccgctaccccgccgtcgctggagcgtctgctcctgcgccactacggcgatgcccctgaggggaccgaccaatga

SEQ ID NO: 144 - protein, 304 aa, Corynebacterium efficiens
  Corynebacterium efficiens YS-314
MAHSDTPAVETIGLSKNFGSVRALDELNLRVEAGEVHGFLGPNGSGKSTAIRVLLGILRSDAGSVKVLGKDPWRDAVELHHRLAYVPGDVELWPNLTGGEAIDLFARLRGRLNVKRRDELIERFDLDPSKKGRTYSKGNRQKVALISALASDVELLLLDEPTSGLDPLMEAQFQELIREEKERGHTVLLSSHILAQVEALADRISIIRKGRIVESGTLLDMRHLSHTVVTVLTDRPTAELITHEGIYNAHREGEQVRFDVDAAHLPEVMSMLAALGVRAITATPPSLERLLLRHYGDAPEGTDQ

SEQ ID NO: 145 - DNA, 810 bp, Bradyrhizobium japonicum
  Bradyrhizobium japonicum USDA 110
  CDS (1)..(810)
atgaccagtcccgcctccatcgccgagccgcgcgacggcgcgccgaagctagatccggcggcggtgccggcgctgtcgatcgacggcgtcagccatgcctacggcccgcgccgggcgttgatggacgtctccttcaacgtgcagcccgcgagcttcaccgcattgctcggcctcaacggcgccggcaagagcacgctgttctcgctcatcacgcggctgttcggcatccagtccggccgcgtcggcatcttcggtcatgacgtcagcaagagccccggcgaggcgctgcggctgctcggcgtcgtgttccagccgcgcacgctcgatctcgatttgtcgctgacgcagaacctgctctatcacgccgcgctgcacggcatcagccaccgcgaggcggccgcgcgcagcgccgaactgctcggccgcatcggcctctccgagcgcgccggcagcaaggtgcgcgatctctccggcggccagatgcggcggctggagatcgcacgcgcgctgctgcaccggccgcgcctgttgttgctggacgagccgaccgtcggcctcgacgtcaaggcgcgcgccgacatcatcagccacgtccgccagctcgtcaccgagcaaggcatcggcgtgctctgggccacgcatctgttcgacgagatcatggccggggacgacctcgtggtgttgcaccagggcaaggtgctggcgcaggggccgatgagccgcgtcgtcaccgaagccggcgcacaggacgtcaacaccgccttcatgcgcctgaccggcgcgcaagtagtgccgggaggcggcgtatga

SEQ ID NO: 146 - protein, 269 aa, Bradyrhizobium japonicum
  Bradyrhizobium japonicum USDA 110
MTSPASIAEPRDGAPKLDPAAVPALSIDGVSHAYGPRRALMDVSFNVQPASFTALLGLNGAGKSTLFSLITRLFGIQSGRVGIFGHDVSKSPGEALRLLGVVFQPRTLDLDLSLTQNLLYHAALHGISHREAAARSAELLGRIGLSERAGSKVRDLSGGQMRRLEIARALLHRPRLLLLDEPTVGLDVKARADIISHVRQLVTEQGIGVLWATHLFDEIMAGDDLVVLHQGKVLAQGPMSRVVTEAGAQDVNTAFMRLTGAQVVPGGGV

SEQ ID NO: 147 - DNA, 705 bp, Clostridium tetani
  Clostridium tetani E88
  CDS (1)..(705): transl_table=11
atgaacgaaattattttagaaacaaaaagattgtgtaaaacatttaaaaaacaacaggcggttaaggaggtttcaatatcagttcagagaaattcaatatatggattacttggaccaaatggagcagggaaatcaacattattgaagatgattataggaatgcttagaccaacttcaggtgaagttttatttgatggacataaatggagtagaaaggatcttatcaaaattggttctttaatagagtcagcacctttgtatgaaaatttaacagcaaaagaaaatttaaaggttagaactacagtacttggattaccagattcaagaatagatgaggtattaagtatagtagaacttgaagacacaggaaaaaagagagcaggacaattttctatggggatgaaacaaagattaggaattgcaattgcacttttaaacaatccaaaacttttaattttagatgaaccaactaatggacttgatccttttggaatacaagaattaagagaacttatacgttcttttccaagcaaaggcattacggtgatattatcaagtcatatactaagtgaagtagaacagattgctgatcatattggaattatatcaggtggagttcttggatatgaaggagaattaaaaaaaggagaagatttagaaaaattatttatgagtattgcgggaaaatataggagggagaagtaa

SEQ ID NO: 148 - protein, 234 aa, Clostridium tetani
  Clostridium tetani E88
MNEIILETKRLCKTFKKQQAVKEVSISVQRNSIYGLLGPNGAGKSTLLKMIIGMLRPTSGEVLFDGHKWSRKDLIKIGSLIESAPLYENLTAKENLKVRTTVLGLPDSRIDEVLSIVELEDTGKKRAGQFSMGMKQRLGIAIALLNNPKLLILDEPTNGLDPFGIQELRELIRSFPSKGITVILSSHILSEVEQIADHIGIISGGVLGYEGELKKGEDLEKLFMSIAGKYRREK

SEQ ID NO: 149 - DNA, 897 bp, Clostridium tetani
  Clostridium tetani E88
  CDS (1)..(897): transl_table=11
atgcttgaaattagcaatgttaataagaaattggggaataaacttatattaaataatgtaaacttaaatgtaagtaaaggaagtatatttggacttataggcgaaaatggtgctggtaaaactactttaattaaatgtataactggtatttataaagttgatagcggaaatataaaaatatttaacgaagaagtatttgaaaatacaaaaatcaaagaaaaaataggatatgtagctgatgaaaatcaatatattccaagttttaaagtatctgaaatgatcaagttttttaaactaacctataagaaattttctatgaatagatttaatgaattaaataaaacatttaaaattcctatagataaaagaataaaagaactttcaaagggtatgaaaatgcgattatccttaatgcttaatttaagtattatgccagaaattttagttttagatgaacctacttctggtctggatcctgttataaagaaaaaagttataaatatacttttagacgatgttgctaaaaacaacactacaatatttatatcttctcatcacttaggagatttggagcgtatatgtgacaatgtagcatttataaataaaggaactatttcctatgtaaacaacatagatgatatgaaacataatataaagaaacttcaagttgtatttaaagataatgtgcctaaagatatacaatcatgggatgaagtattaaccattgaatccataggaagagttaactatgtgattacaaagaagttttctaaagaattggaagaaaaacttaaatctatgagtgccctatttatagaagagctagatttaagtcttgaggatatgtttatttattctgtagaggaggatgaacacaatgaaaaaattcttgcataa

SEQ ID NO: 150 - protein, 298 aa, Clostridium tetani
  Clostridium tetani E88
MLEISNVNKKLGNKLILNNVNLNVSKGSIFGLIGENGAGKTTLIKCITGIYKVDSGNIKIFNEEVFENTKIKEKIGYVADENQYIPSFKVSEMIKFFKLTYKKFSMNRFNELNKTFKIPIDKRIKELSKGMKMRLSLMLNLSIMPEILVLDEPTSGLDPVIKKKVINILLDDVAKNNTTIFISSHHLGDLERICDNVAFINKGTISYVNNIDDMKHNIKKLQVVFKDNVPKDIQSWDEVLTIESIGRVNYVITKKFSKELEEKLKSMSALFIEELDLSLEDMFIYSVEEDEHNEKILA

SEQ ID NO: 151 - DNA, 918 bp, Streptomyces avermitilis
  Streptomyces avermitilis MA-4680
  CDS (1)..(918)
atgagttccacccgcaccaccgcggacgtcgccctggaggcgtaccggctcggcaagcggtacggcaggcgcccgtccgcggccctggacgactgctccttccgcctcccggccggccgcgtcagcgcactggtgggccccaacggggccgggaagtcgaccctgctggcgctggcggccggactgctgcggcccacctcgggcacgctcaccgtcctcggcggggctcccggcgaagcccgcgaccgcgtcgcctacctctcccaggacaagccgctgcacccccagctcaccatcgccgagaccctgcgcctgggcgccgagctcaacccgggccgctgggacgccgcccacgccgcctcgctggtcgaacagggctcgctcgaccccgcgacgaagatccgccggctctccggcggccagcgcacccgcgtcgccctcgccctcgcgctcggcaagcggcccgacctgatgctgctcgacgagccgatggccgacctcgacccgctcgcccggcacgagatgatgggcacgctgatggcggacgccgccgagcgcggcacgacggtgctgatgtcctcgcacatcgtcgccgaactcaccgacgcctgcgaccacctgctgctcctgggcgacggccgcatccggctcggcggcggcatcgacgacctgctcaccgcgcactccctggtgaccggccgcggaacgcccgccgacctcgccccgcacacggtcgtcgagtcccgggccagcggccgcggcctgaccgcgctgatccgccgcgacggacccgtcgacagcggctgggaggtccaggaaccgtccctggaggaactgctcctcgcccacctgcgcgccccgggcgccccggccctgatcactccgggcacggccgtctccgtggaggtgaccgcatga

SEQ ID NO: 152 - protein, 305 aa, Streptomyces avermitilis
  Streptomyces avermitilis MA-4680
MSSTRTTADVALEAYRLGKRYGRRPSAALDDCSFRLPAGRVSALVGPNGAGKSTLLALAAGLLRPTSGTLTVLGGAPGEARDRVAYLSQDKPLHPQLTIAETLRLGAELNPGRWDAAHAASLVEQGSLDPATKIRRLSGGQRTRVALALALGKRPDLMLLDEPMADLDPLARHEMMGTLMADAAERGTTVLMSSHIVAELTDACDHLLLLGDGRIRLGGGIDDLLTAHSLVTGRGTPADLAPHTVVESRASGRGLTALIRRDGPVDSGWEVQEPSLEELLLAHLRAPGAPALITPGTAVSVEVTA

SEQ ID NO: 153 - DNA, 942 bp, Bacillus cereus
  Bacillus cereus ATCC 14579
  CDS (1)..(942): transl_table=11
atgatgaatacattagaaattaaaaatttaacgaaaaaatttggtaatttcatcgcagttgataatatgtccttatctattaaagaaggagaaatatttggctttttaggatcaaatggtgctggtaagagtacaacgataaatatgattgctggtttgttaagaagtaatgaaggtgagattagcatactaggaaaaaatataaagaaacataatcgatttgcgaaaatgaatatcggtattgttccgcaagatattgcgatttatgaagagttaactgcctatgaaaatgtgaaattctttgctggattgtacgggttacgaggagccgaattaaaagctagggtagaggaagctcttaaatttgtaggacttagtgataaacagaaaagctatccgaagaacttttctggtgggatgaagcgaagactgaatatcgcttgtgcaattgctcatagaccgaagttaattattatggatgagccgacagttggaattgatccacagtcaagaaactacattttgcagtcagtacgtaaattaaatgaaatgggaagtacaattatttatacgagtcactacatggaagaggtagaagagatttgtacgaaaatagcgatagtagatcacggtaaagtaattgcagaaggtacgaaagaacagttaaaagcaattattactgacacgaaagatatttggattgaagtgaaatcggtagagaatttagatgtagaaaaattaaaagagataaacggtgtgaaagcagttcaaattgaagaaaacgtaattaaagtgaattctgatgcaggattaaataatttaaataaaatcattcaacactgtatcaatcatgatattgaaattcgttcattagaggagcaggctcccaacttagaaacagtatttcttaccttaaccggaagaaacttacgagataaataa

SEQ ID NO: 154 - protein, 313 aa, Bacillus cereus
  Bacillus cereus ATCC 14579
MMNTLEIKNLTKKFGNFIAVDNMSLSIKEGEIFGFLGSNGAGKSTTINMIAGLLRSNEGEISILGKNIKKHNRFAKMNIGIVPQDIAIYEELTAYENVKFFAGLYGLRGAELKARVEEALKFVGLSDKQKSYPKNFSGGMKRRLNIACAIAHRPKLIIMDEPTVGIDPQSRNYILQSVRKLNEMGSTIIYTSHYMEEVEEICTKIAIVDHGKVIAEGTKEQLKAIITDTKDIWIEVKSVENLDVEKLKEINGVKAVQIEENVIKVNSDAGLNNLNKIIQHCINHDIEIRSLEEQAPNLETVFLTLTGRNLRDK

SEQ ID NO: 155 - DNA, 894 bp, Bacillus cereus
  Bacillus cereus ATCC 14579
  CDS (1)..(894): transl_table=11
atgatttcagttcaagatgtcacaaaacagttttcgaatggaaaaggtttgtttcatattacatttgatgtaaaagagggagaagtatttggttatttaggaccgaatggtgccggaaaatcaacgacgattcgtaatttaatgggatttataaaaccgacagctggtaaagcgacaatttttggattagattgttggaatgaagcagcgaaaattcaaagggaagttggttacttgccaggtgaaatttcttttattgaaggaatgaatggattagagtttttaaaattaatgcagggaatgcgtggattaaaggatacgaaaagacgagatgaactgatagagcgtctgcaatttgatgtgaaaacaccgattcgcaaaatgtctaaaggaatgaagcaaaaagtagggatagtcgctgcatttatgcacgatccagaggtgttaattttagatgaaccaacatctggacttgatccacttatgcaacaagtgtttatagatttaatattagaggaaaagcaaagaggaaaaacaatcctaatgtcatcacatatttttactgaaattgagagaacttgtgacagagtagctattattaaagatggtcgactcgtaacggttgaaaatattcacgatttacaaagtatgagaagacaggtgatagatgtaacagtatcatcacaagaagagattgagtcccttacaaagtgtaatttgcaatttgaagcggtaaaaggtagagaggcatctatcattgtacaaggaaactatcaaactgttttacaaacactttcaaactataatgtaacggcacttcaaacgagagcgatggatttagaacatttatttatgcattattacgataagaaagaaggggtaacgcatgaataa

SEQ ID NO: 156 - protein, 297 aa, Bacillus cereus
  Bacillus cereus ATCC 14579
MISVQDVTKQFSNGKGLFHITFDVKEGEVFGYLGPNGAGKSTTIRNLMGFIKPTAGKATIFGLDCWNEAAKIQREVGYLPGEISFIEGMNGLEFLKLMQGMRGLKDTKRRDELIERLQFDVKTPIRKMSKGMKQKVGIVAAFMHDPEVLILDEPTSGLDPLMQQVFIDLILEEKQRGKTILMSSHIFTEIERTCDRVAIIKDGRLVTVENIHDLQSMRRQVIDVTVSSQEEIESLTKCNLQFEAVKGREASIIVQGNYQTVLQTLSNYNVTALQTRAMDLEHLFMHYYDKKEGVTHE

SEQ ID NO: 157 - DNA, 924 bp, Corynebacterium diphtheriae
  Corynebacterium diphtheriae NCTC 13129
  CDS (1)..(924): transl_table=11
atgagtacgccagtcattcaagtctccgaacttaccaagtcgttctaccggcacggccaacgtgggcttgttgccgtcgatcgggtgtcgtttagcgtcccacagggtcagattgttgcttttttgggtccaaacggtgctggaaaatccacaacgatcgacatgattttggggctcagctcgcctgattctggtcaggtgaaagtacttggtgagcctccgcacaaagccgcatgctctggaaagtgccaggcagtgcttcagtctggtgggttgcttcccgacttcacagtgcgggaaactattcaggcagttgccgccgcacatggagcgcgtgggcgggtagaagacgtgattaagcgttgggatctgtctagttttgctcgcagaaaagtagagaaatgctccgggggccagcaacagcgattgcgttttgcgttggccatgctctcagatccgcaagtgcttatctttgatgagcccactgccggattggacgttgaggcacgtcggaagttttggcgcatcatgcgcgaagaagcggatgctggccgcacgattatttttgctactcattacatcgaagaggcggatgatttcgcggagcgcgtcatctttatcagcgaaggaaaaatcgttactgatggccccatcgaaaaaattagggcgtcagttcgaggtgcaaccgttagcgctgttattccgggtgcttccacgaaagagctcgctggcctgcctggggttaagaccgtaagcattaacggtgatcgaatcacactggacactacgcagccagacgacgttgcgcgatacctccttaatcgcacatctgcttatgacttgttagtttcaacgacatcgcttgaagacgcatttattgagctgactcattcacgcgatgctaaggcaaaggacgcagcatga

SEQ ID NO: 158 - protein, 307 aa, Corynebacterium diphtheriae
  Corynebacterium diphtheriae NCTC 13129
MSTPVIQVSELTKSFYRHGQRGLVAVDRVSFSVPQGQIVAFLGPNGAGKSTTIDMILGLSSPDSGQVKVLGEPPHKAACSGKCQAVLQSGGLLPDFTVRETIQAVAAAHGARGRVEDVIKRWDLSSFARRKVEKCSGGQQQRLRFALAMLSDPQVLIFDEPTAGLDVEARRKFWRIMREEADAGRTIIFATHYIEEADDFAERVIFISEGKIVTDGPIEKIRASVRGATVSAVIPGASTKELAGLPGVKTVSINGDRITLDTTQPDDVARYLLNRTSAYDLLVSTTSLEDAFIELTHSRDAKAKDAA

SEQ ID NO: 159 - DNA, 894 bp, Bacillus cereus
  Bacillus cereus ATCC 10987
  CDS (1)..(894): transl_table=11
atgatttcagttcaaaatgtcacaaaaaaattttcaaatggaaaaggtttgtttcatattacatttgaagtgaaagaaggggaagtattcggttacttaggaccaaatggtgccgggaaatccacaacaattcgtaatttaatggggtttataaaaccgacagatggtaaagcgacaatttttggattggattgttggaatgaagcagcgaaaattcaaagagaagttggctatctaccaggagaaatctcttttattgaaggaatgaacggattagagtttttgaagttaatgcaaggaatgcgtgggctaaaggatacgaaaagacgagatgaattaatagaacgtcttcaatttgatgtgaaaacaccaattcgaaaaatgtctaaaggaatgaagcaaaaagtagggattgtcgctgcatttatgcatgatccagaggtgttaattttagatgaaccgacatcaggacttgatccacttatgcagcaagtgtttatagatttaatagtagaggaaaagcaaagaggaaaaacaattcttatgtcttcacatattttcactgaaattgagcgtacatgtgaccgagtagcgattattaaagatgggcgccttgtaacggttgaaaatattcatgatttacaaagtatgagacgacaggtgatagatgtaactgtatcatcagaggaagagattgcctctctcgcgcaatgtaatttacaatttgaagcggtgaaaggtagagcggcatctattattgtacaaggaaactatcaaactgttttacaaatactttcaaactataatgtaacggcacttcaaacgagagcaatggatttagaacatttatttatgcattattacgataagaaagaaggggtaaagcatgaataa

SEQ ID NO: 160 - protein, 297 aa, Bacillus cereus
  Bacillus cereus ATCC 10987
MISVQNVTKKFSNGKGLFHITFEVKEGEVFGYLGPNGAGKSTTIRNLMGFIKPTDGKATIFGLDCWNEAAKIQREVGYLPGEISFIEGMNGLEFLKLMQGMRGLKDTKRRDELIERLQFDVKTPIRKMSKGMKQKVGIVAAFMHDPEVLILDEPTSGLDPLMQQVFIDLIVEEKQRGKTILMSSHIFTEIERTCDRVAIIKDGRLVTVENIHDLQSMRRQVIDVTVSSEEEIASLAQCNLQFEAVKGRAASIIVQGNYQTVLQILSNYNVTALQTRAMDLEHLFMHYYDKKEGVKHE

SEQ ID NO: 161 - DNA, 813 bp, Eremothecium gossypii
  CDS (1)..(813)
atggacaccagccaagcagtggaggttacaggcctcagctacaagttcccacacgccgaggaggagtcgctcacagacgtgaacctggtgttgccgtggcgcaagcgcatgctgctctgcggctccaacggcgccggcaaatccacgctgctcaagttgctcagtggcaagcatctgtgccgcagcggtaatatccgcgtcgacggccgcgacccgtttgctcccgctaacacggccgatcccgcggatgtcatggtcactgcataccttggtaccgagtggtgccacatggccatagtgcaccgcgacatcggcgtgcaggaactgcttgacagcatcggcctgcagcacttccgcgagcgcggcacagagctgttgcgtatcctcgacgtcgacctccgctggcgcatgcaccgcctcagcgacggccagaagcgccgcgtccagctttgcatgggcctgctcaagcccttcaagctgctgctgctcgacgaggttactgtcgacctcgacgtggtcgcccgcaccaagctgctgcactttctccgcctggagaccgagcgccgcgagtgcagcattatttacgctacccatattttcgacggtttggctgattggccggaccgcgttgtccacatcgcccacggccgtgtgttggccgacctcgatgtcgcccgcgatgtcagttttgccgcagaccgcaccgacgtcgtcgaagccgccggacgtgtccgtatcgggcacgtacgcagcctgcatccgctggcactagcatggctcgcccgtgacgagggcaagatggcctccgagtaa

SEQ ID NO: 162 - protein, 270 aa, Eremothecium gossypii
MDTSQAVEVTGLSYKFPHAEEESLTDVNLVLPWRKRMLLCGSNGAGKSTLLKLLSGKHLCRSGNIRVDGRDPFAPANTADPADVMVTAYLGTEWCHMAIVHRDIGVQELLDSIGLQHFRERGTELLRILDVDLRWRMHRLSDGQKRRVQLCMGLLKPFKLLLLDEVTVDLDVVARTKLLHFLRLETERRECSIIYATHIFDGLADWPDRVVHIAHGRVLADLDVARDVSFAADRTDVVEAAGRVRIGHVRSLHPLALAWLARDEGKMASE

SEQ ID NO: 163 - DNA, 894 bp, Neurospora crassa
  CDS (1)..(894)
atggcctcccaaccagcccccccaacagtggaaaccttcaacctcacctacagctttcccgaccgctccaacggcgtctcggacattaccctctccctcccgcctcgctcacgcacgctcctgattggcgccaacggtgccggcaaaaccaccttgcttcgcctgttggccggcaagcgtctcgcgcccgccaacaccatcaaagtgtcgggcgttgacccgttcaaggaaggtctggagggcgtcacctacttggggttggaatgggtcctcaacgcgattgtgcgcacggacattggtgtcgttgagctgctgcggtcagtgggcggcgatgcttatcccgagagaagggatgaattggtgtcggtgctggatatcgacaccaactggcgaatgcacgccgtgtcggacggagaacgccgcagggtgcagctggcaatgggcttgatccggccctggacggtgctgttgctggacgaaatcaccgtcgacttggatgtctggtcccgggcgcagtttctagggtggctgagacgggagacggagacgagagagtgcacggttgtgtacgcgacgcacatcctggacaacttggccagttggccgacgcacctggtgcacatgcacttgggcactgtgaaggggtgggggaaggcggaggagatgttgaaggaggtcgaggatgggaagaatgtgattgaaggcgtgacgggaaatagtaggctgggagagctggtgttgaggtggttgagggatgatttgaaggagagagggccgagaagccagcacaggaggggaccggaggggttgagttataacagcccgggcttgggcggttatgggttggaggcgaagacgaatcaacaggctacggatgggcctagctgcaactga

SEQ ID NO: 164 - protein, 297 aa, Neurospora crassa
MASQPAPPTVETFNLTYSFPDRSNGVSDITLSLPPRSRTLLIGANGAGKTTLLRLLAGKRLAPANTIKVSGVDPFKEGLEGVTYLGLEWVLNAIVRTDIGVVELLRSVGGDAYPERRDELVSVLDIDTNWRMHAVSDGERRRVQLAMGLIRPWTVLLLDEITVDLDVWSRAQFLGWLRRETETRECTVVYATHILDNLASWPTHLVHMHLGTVKGWGKAEEMLKEVEDGKNVIEGVTGNSRLGELVLRWLRDDLKERGPRSQHRRGPEGLSYNSPGLGGYGLEAKTNQQATDGPSCN

SEQ ID NO: 165 - DNA, 873 bp, Magnaporthe grisea
  Magnaporthe grisea 70-15
  CDS (1)..(873)
atggccgacggaagttccacgccgagatcgccctcactcgaggtcaaagacttgacgtacagctttccagaccggagcaccggcattagcaacatcagtctttcgctgccagcccggagtcggacctgcctcatcggcgccaatggagccggcaagacgaccctcctccgcctcctggcaggtaagcgcctctccccgcgcggcgccatcaccgtgggcggcgtggaccccttctccgagggcctcgagggggtgacgtacctggggctggagtgggtgctgaacccgatcgtgcgcaccgacattggcgtcgccgagctgctccgctcggttggtggggacgcctacccagcgcggcgcgacgagctggtcgaggtgctggacattgacaccgcgtggcgcatgcacgccgtgtcggacggcgagcggcggcgcgtccagctggccatgggcctggtgcggccgtggacggtgctgctgctcgacgagatcacggtcgacctcgacgtgctgtctcgttcgggcttcctcgactggctcaagcgcgagaccgagtcccgcgacgccaccgtcgtctacgccacccacattctcgacaacctgcatgcttggcccacccacttggtgcacatgcacctcggcaccgtcaaggagtggggtcccgccgccgactttctcgaggcccagggtgcctccaaggacggcaatagccagctcggccacctggtcctgggctggctgcgggaagacctcaaggaccgcggtccgaggagccagcacaagagggctcccgagggcaagtcgtatggtgccggcgggatcgagctcggcggatacggatacgagcccaaggcaccgcccaaggggcagtaa

SEQ ID NO: 166 - protein, 290 aa, Magnaporthe grisea
  Magnaporthe grisea 70-15
MADGSSTPRSPSLEVKDLTYSFPDRSTGISNISLSLPARSRTCLIGANGAGKTTLLRLLAGKRLSPRGAITVGGVDPFSEGLEGVTYLGLEWVLNPIVRTDIGVAELLRSVGGDAYPARRDELVEVLDIDTAWRMHAVSDGERRRVQLAMGLVRPWTVLLLDEITVDLDVLSRSGFLDWLKRETESRDATVVYATHILDNLHAWPTHLVHMHLGTVKEWGPAADFLEAQGASKDGNSQLGHLVLGWLREDLKDRGPRSQHKRAPEGKSYGAGGIELGGYGYEPKAPPKGQ

SEQ ID NO: 167 - DNA, 864 bp, Gibberella zeae
  Gibberella zeae PH-1
  CDS (1)..(864)
atgactcttcctcctaagccccctcgtgtcgaggtcaacaacctctcatacacgttccctgactactcaactggtgtcaacaacattactctcgaccttcccccgcgatcccgtactctgctcattggcgccaacggtgccggtaagacgactctgcttcgtctcctcgctggcaagcgtcttgcgcccagtgacaccatctctatctgcggagttgatcctttcaaggaaggtcttgagggtgtcacttatctcggtctcgaatgggttctcaaccccattgtccgaactgatattggtgtcaacgagctgctcagctctgttggcggtgatgcgtaccccgatcgtcgagatgagcttgtagccatgctcgacgtcgacaccaactggcgcatgcacgctgtttctgacggtgagcgtcgtcgcgttcagcttgcaatgggtcttctgagaccctggactgtcctgcttctcgatgagatcactgttgatctcgatgtcctgagccgtgccgaattcctcgcctggctcaagaacgagacagagatccgagagtgcaccatcgtttacgctacccatatcctggacaaccttgctggctggcctactcacctcgcgcatatgcacctcggtactgtcaaggagtgggacgaggccgacaagatgcttgccaccatcgacggcactgtcggtgcctctggcaacagtcgtctgggagagctcgtcctgagctggctccgcgatgacctgaaagagcgaggaccacgaagcggtatcaaccgcggttctgaaggcaagacgtacggttttggaggaatccagattggcggctatggcgacgagtctaagccgcgtaaagaatag

SEQ ID NO: 168 - protein, 287 aa, Gibberella zeae
  Gibberella zeae PH-1
MTLPPKPPRVEVNNLSYTFPDYSTGVNNITLDLPPRSRTLLIGANGAGKTTLLRLLAGKRLAPSDTISICGVDPFKEGLEGVTYLGLEWVLNPIVRTDIGVNELLSSVGGDAYPDRRDELVAMLDVDTNWRMHAVSDGERRRVQLAMGLLRPWTVLLLDEITVDLDVLSRAEFLAWLKNETEIRECTIVYATHILDNLAGWPTHLAHMHLGTVKEWDEADKMLATIDGTVGASGNSRLGELVLSWLRDDLKERGPRSGINRGSEGKTYGFGGIQIGGYGDESKPRKE

SEQ ID NO: 169 - DNA, 693 bp, Aspergillus nidulans
  Aspergillus nidulans FGSC A4
  CDS (1)..(693)
atgtccgactcgccagacatccaagtgcagaacctctcctacaagttcccagacggctcctccggcttaacagacccaatggagccggaaggtctcgagggcgtcacctatctcggcgtagaatgggtgctcaacagcatcgtccggacagacatcgacgtccccacgctcctcgcctccgttggcggcaacgcctaccccgaacgccgtgacgagctcgttgaaattcttgacattgacctgcgatggcgcatgcatgcagtttcggacggagagcgccgtcgcgtccagctagccatgggtcttctccggccgtggcaggtgcttctcctggacgaaatcaccgtcgacttggacctgctgtcgcggagcaacttcctttcgttcttgaagagggagacagagaccaggccctgcacgattgtgtacgcgacgcatatcttggataatctggcgcattggccgacacatttggtgcatatgcatctcggcaatgtaaggcagtggggcgctattgagaaattcaaggaggaggcacctgaaacgtcggaaaacagccaactcggagagattgttctcaagtggttgaaggaggacttgcaggctagaggaccgcggaatgtacgtggcagccaggcaaaaacttacgaggctgggggaattggagggtatgggtatgagaaaaaggcctag

SEQ ID NO: 170 - protein, 230 aa, Aspergillus nidulans
  Aspergillus nidulans FGSC A4
MSDSPDIQVQNLSYKFPDGSSGLTDPMEPEGLEGVTYLGVEWVLNSIVRTDIDVPTLLASVGGNAYPERRDELVEILDIDLRWRMHAVSDGERRRVQLAMGLLRPWQVLLLDEITVDLDLLSRSNFLSFLKRETETRPCTIVYATHILDNLAHWPTHLVHMHLGNVRQWGAIEKFKEEAPETSENSQLGEIVLKWLKEDLQARGPRNVRGSQAKTYEAGGIGGYGYEKKA

SEQ ID NO: 171 - DNA, 885 bp, Candida glabrata
  Candida glabrata CBS138
  CDS (1)..(885)
atgacggactacgcagtcgaagttacagacctcacttaccgttttaaagagagccctgaaccagccgtcgagaatatcaacttaaaggttccctggaacacaagaactctggttgttggtgctaatggtgcaggtaagtcgacactactgaagctgctcagtggtaagcatttatgcctaactgggaatatcaaagttaatggcctcgacccattcagtccgctttcaatgactacttcaatagacaatactctcattgagaatgacgatggttttggaaataaaggtgaatgtcaggtatccacatatttaggtacagaatggtgccatatgagcattattaatagagacataggagtacttgaactattggatagcattggttatcagtttttcaagcagaggggtgatagacttattgatattctggatatcgatgtcaattggagaatgcatcgtttgagtgatggtcaaaagagacgtgttcaactagcaatgggacttttaaagccttggagagtgctcttactggatgaggtaacagttgacctggatgttattgcacgcatgcgtctattagattttttgaagtgggaaacaactaatagaaagtgttcagtagtgtacgcaacacatatttttgacggtttggctgcttggcccgattatgtcttacatatgcaaagtgggaaaatagtctcaaaattagactataagaacgatgttacattctgcaatgccaaagaggactcagaagccaatggcaaagtaattgttaaggagaacggtcagaaactggatgtgatccgtctaaatagtttacacccattagcaattcactggctacaaggagaccattccaagatatcaccagggttgtcataa

SEQ ID NO: 172 - protein, 294 aa, Candida glabrata
  Candida glabrata CBS138
MTDYAVEVTDLTYRFKESPEPAVENINLKVPWNTRTLVVGANGAGKSTLLKLLSGKHLCLTGNIKVNGLDPFSPLSMTTSIDNTLIENDDGFGNKGECQVSTYLGTEWCHMSIINRDIGVLELLDSIGYQFFKQRGDRLIDILDIDVNWRMHRLSDGQKRRVQLAMGLLKPWRVLLLDEVTVDLDVIARMRLLDFLKWETTNRKCSVVYATHIFDGLAAWPDYVLHMQSGKIVSKLDYKNDVTFCNAKEDSEANGKVIVKENGQKLDVIRLNSLHPLAIHWLQGDHSKISPGLS

SEQ ID NO: 173 - DNA, 822 bp, Kluyveromyces lactis
  Kluyveromyces lactis NRRL Y-1140
  CDS (1)..(822)
atggcctcgaacgacctagcagtggaagtgcacgatctaacgtacgcattccccggaagtaaacgctcagcaatccacgatctatcgctaagtgtcgaatggaacaagaaagtcttagtggtgggtaacaacggtgctggaaaatctacgctgttgaaactactaagtggtaaacatttgtgtctcggtgggaacataaaagttggaaacaagaacccattcgcaccaaacaatgaccaggagtccgtgatactgactacttacttaggcactgaatgggctagtatggctattgtacacagggatataggagtcctggaactcttggagagtatcggactaagccactacagggctcgaggtgaagagctagtgagaatcttggaagtggatatcaattggagaatgttcaaacttagcgatggccaaaagagacgtgtacaactgtgcatgggtttattgaaacccttcaaagttctgctattagacgaagtcactgtggacttggatgtcgtggcacgtgaccgtctattccaattcctggatcgagaaacgagagacagacaatgtagcgttgtgtatgcaacgcacattttcgatgggctagcaccatgggctgatgagattatccatttgcaagatggcaccatcacaagaacgttggattaccaacgtgatatccactttacaaaggaaatagagggcgtccaagagcgaaaggacaacggacgacacaccgtgatactaggctacatgaagagtttatacccgcttgcactccactggttgaccagagaccaagtcgaagaccaaaagctttga

SEQ ID NO: 174 - protein, 273 aa, Kluyveromyces lactis
  Kluyveromyces lactis NRRL Y-1140
MASNDLAVEVHDLTYAFPGSKRSAIHDLSLSVEWNKKVLVVGNNGAGKSTLLKLLSGKHLCLGGNIKVGNKNPFAPNNDQESVILTTYLGTEWASMAIVHRDIGVLELLESIGLSHYRARGEELVRILEVDINWRMFKLSDGQKRRVQLCMGLLKPFKVLLLDEVTVDLDVVARDRLFQFLDRETRDRQCSVVYATHIFDGLAPWADEIIHLQDGTITRTLDYQRDIHFTKEIEGVQERKDNGRHTVILGYMKSLYPLALHWLTRDQVEDQKL

SEQ ID NO: 175 - DNA, 966 bp, Debaryomyces hansenii
  Debaryomyces hansenii CBS767
  CDS (1)..(966)
atgactgatagcgccaacgaccatacattagccgtagaaacgattgacttaacttataagttcccttcaaaccaaaaaattggattacaggatgttaaccttcaaatcccatgggggtcaactaatttacttatcggacaaaatggtgctgggaaatctactttattaaagatcttagcaggtaagacattaattaagcaaggtaaactaaaactaggaggatttgatccatttgatttttcaaaagagaggaacgaaagacagaattctgatgtcaataatttaattacttacttaggtacggaatgggcagccaatccagttgttaaaagagatatccctgtcaacttattagtttcctcgattggcggaggaacttatccagaaaggagagacgaattgattagaattatggatatcgatcctgaatggtcaatggcatatatttccgatggtgagagaagaagggtccaattagtgatgggtttattgaagccatggaaattattattattagatgaggtgacagttgacttagacgtggtcgttagacaagatttacttaattttttgaagaaagaatgcagactccgtaattgttgtgtaatatatgctacacatatttttgacggattaggcaaacattggtgtgatagacttattcatttaaacgagggaatgaaggtgaacgatataaacatgaaagatatagaatttgtatcaaaaaacgagcaactggacaaggttaatgacaaagcgatacaagtggaattagcagaatcattgcatcctttggcattgcattggctaagggatgacttaaggaaaagagggtcaagagaagaagagaagattaaaatggccaaaagacaagaagaatggaataatgcaagagatgatacttattttgatgccaaggaatcaaaattaaaggattacttcaaggcaactagaagtgctaaataa

SEQ ID NO: 176 - protein, 321 aa, Debaryomyces hansenii
  Debaryomyces hansenii CBS767
MTDSANDHTLAVETIDLTYKFPSNQKIGLQDVNLQIPWGSTNLLIGQNGAGKSTLLKILAGKTLIKQGKLKLGGFDPFDFSKERNERQNSDVNNLITYLGTEWAANPVVKRDIPVNLLVSSIGGGTYPERRDELIRIMDIDPEWSMAYISDGERRRVQLVMGLLKPWKLLLLDEVTVDLDVVVRQDLLNFLKKECRLRNCCVIYATHIFDGLGKHWCDRLIHLNEGMKVNDINMKDIEFVSKNEQLDKVNDKAIQVELAESLHPLALHWLRDDLRKRGSREEEKIKMAKRQEEWNNARDDTYFDAKESKLKDYFKATRSAK

SEQ ID NO: 177 - DNA, 879 bp, Oryza sativa
  Oryza sativa (japonica cultivar-group)
  CDS (1)..(879)
atggccggcggcgaggacgaagggtggaggaggagcggcatcgaggtgagcgcactgcagttcgactacgacgggcagccgccgctcttcgcgcggttcaatctccgcatcgcccccggctcacgatgcctcctcatcggcgcgaacggatcaggcaagaccactctcttgaagattcttgcggggaaacatatggttggaggaagagatgttgtccgtgttcttaatggttctgcttttcatgacacacagcttgtgtgcaacggtgacctttcctacttaggtggttcatggagtcgggctatcggttcagctggtgacgttcctctgcaaggcgacttctctgctgaacacatgatttttggagttgatggggttgatcctgttaggcgagagaagcttgttgatctactagatattgatctgcaatggcgcatgcataaagtctcagatggacaacgccgcagggtacaaatctgcatgggtcttcttcatccatacaaggtactcttgcttgatgaaatcaccgttgatcttgatgttgtgactagaatggatctccttgacttctttaaggaagagtgtgaacagagagaagcaaccattgtctatgccactcatatatttgatggattggaatcatgggctactgacattgcatacatccaagaaggtgaattgagaaaatcagcaaaatactctgacgttgaggagctaaagagtgccaaaaacttgctgtcagttgtcgagtcatggctgcgatctgagaccaaactccctaagaaagaacatccccgtcctgagacccagcccaggcgctcctctccatttgatgcttcaccgttccgatcttcacgccacatggcctactaccgttga

SEQ ID NO: 178 - protein, 292 aa, Oryza sativa
  Oryza sativa (japonica cultivar-group)
MAGGEDEGWRRSGIEVSALQFDYDGQPPLFARFNLRIAPGSRCLLIGANGSGKTTLLKILAGKHMVGGRDVVRVLNGSAFHDTQLVCNGDLSYLGGSWSRAIGSAGDVPLQGDFSAEHMIFGVDGVDPVRREKLVDLLDIDLQWRMHKVSDGQRRRVQICMGLLHPYKVLLLDEITVDLDVVTRMDLLDFFKEECEQREATIVYATHIFDGLESWATDIAYIQEGELRKSAKYSDVEELKSAKNLLSVVESWLRSETKLPKKEHPRPETQPRRSSPFDASPFRSSRHMAYYR

SEQ ID NO: 179 - DNA, 762 bp, Yarrowia lipolytica
  Yarrowia lipolytica CLIB99
  CDS (1)..(762)
atgtcgatcacggcgcaaaacctctcctacaccttccccaatgggcttgtgggcatccatcccacctcgttcgacctgcctcccgggtctagaacgttgctgatcggagccaatggagctggaaagtcgacgttgctgcgaattctggcgggaaagaccctcgccaaggccgacagtctcattgtccagggctttgatcccttccgagactgttctcctcctggaatccggtacctgggcaccgaatgggccggcaatccaatcgtgagacatgacattgaggtcacccagctgctaaagtacgccggaggagatgcctatcctgaccgacgagaccatcttgtgcagctgctggacgtggatcccacctggcacatgcacgaggtgtctgacggagagcgtcggcgagtgcagctagtcatgggactgctggtgccgtgggaaactcttctgctggacgaggtgacggttgatctggacgttctggcccgaactaacctgctcaacttcctcaaggaggagaccgagacccgacaagccaccattgtttacgccacccatattttcgacggcctcaaccagtggcctacgcacgttgcccatatgagccagtccaccatgttgagttgcgacacctacgatgtggtccagcgggagttccccggcaagagcattctggaaattgcactgggctggatcaccggggatatggaacggcgtgggcctcgcctccccagagcaaagagacagagggttaactag

SEQ ID NO: 180 - protein, 253 aa, Yarrowia lipolytica
  Yarrowia lipolytica CLIB99
MSITAQNLSYTFPNGLVGIHPTSFDLPPGSRTLLIGANGAGKSTLLRILAGKTLAKADSLIVQGFDPFRDCSPPGIRYLGTEWAGNPIVRHDIEVTQLLKYAGGDAYPDRRDHLVQLLDVDPTWHMHEVSDGERRRVQLVMGLLVPWETLLLDEVTVDLDVLARTNLLNFLKEETETRQATIVYATHIFDGLNQWPTHVAHMSQSTMLSCDTYDVVQREFPGKSILEIALGWITGDMERRGPRLPRAKRQRVN

SEQ ID NO: 181 - DNA, 807 bp, Cryptococcus neoformans
  Cryptococcus neoformans var. neoformans JEC21
  CDS (1)..(807)
atgccagcggcggatcaactggccatcgactgtcaaagtctcacctattcatggaaagaaggagacgatccagtcctcgaaaatgtgaacctcgagcttcgaaagggggataggtgtctgctattgggtgctaacggagcgggaaaatcgacacttttaaggattttagcaggcaagagattgaccaagacgaggacttgtcggatcttggggcaggacgtattcatgagccctccaggtggtgttgtctatctcggaacagaatggtcctccaaccccgttgttcgctcggacattgttgtttctcatttcttagactctgtggggggttacaggcacaaggagaggagagataggcttttgaggatcctcgatgtcgatcttgactggcatatgcaccaaatctctgatggagagcgtcgtcgggtccagctttgtatgggacttatgggagaatgggatgtcttgcttctggatgaagtcactgttgatctggatgtgctcgttcgtgcagacttgattgattttctgatttctgaatccgaaacaagaggtgctactattgtctatgccacccacatctttgatggcctcaaaaaattccctacaaaaatttgtcacatccagctaggctcaactcctcgtggcctcatcgcttggcctcctgccgacaaagggttgcaagaggaaacgcttttcgagttggcattaggctggttgagggaggatagagatctgagaaggcagaaagaaaatgagaagggaaggacgagagggcccaagacggatgtaagtgttactcgctaa

SEQ ID NO: 182 - protein, 268 aa, Cryptococcus neoformans
  Cryptococcus neoformans var. neoformans JEC21
MPAADQLAIDCQSLTYSWKEGDDPVLENVNLELRKGDRCLLLGANGAGKSTLLRILAGKRLTKTRTCRILGQDVFMSPPGGVVYLGTEWSSNPVVRSDIVVSHFLDSVGGYRHKERRDRLLRILDVDLDWHMHQISDGERRRVQLCMGLMGEWDVLLLDEVTVDLDVLVRADLIDFLISESETRGATIVYATHIFDGLKKFPTKICHIQLGSTPRGLIAWPPADKGLQEETLFELALGWLREDRDLRRQKENEKGRTRGPKTDVSVTR

SEQ ID NO: 183 - DNA, 843 bp, Aspergillus fumigatus
  Aspergillus fumigatus Af293
  CDS (1)..(843)
atggcagactcggacaatcatacgggtccttcgatcaatgtgaatggcctaaattataagttcccggatggttcttcaggcttgacaaatgtgtctctcagtctccccgcagggagccggacattgctcattggagcaaatggtgccggcaagaccactctcctgcgcttgctggcaggcaagcgcttggccccgacagatacagtttctgtttctggcagggatccctttaagcacggcctcgaaggggtgacttacttaggtgttgagtgggttctgaacagcattgtccggacggacatcgacgtcccaacgctcctagcatctgtgggtggagacgcctatcccgagcgcagggatgagctagttgagattctcgacattgacctccggtggcgtatgcacgccgtgtcggacggtgagcgccgccgtgtgcagctggcgatgggtctgctgcgcccttggcaggtgctcctgctggatgaaatcaccgtggacctggacttgctttctaggagtaacttcctttccttcctcaagcgggagacagagacaagaccctgcacgattgtctatgccacacacatcctggataatctgtcgcagtggcccacccatctcgtgcatatgcacctcggaaacgttaggcaatggggccctatggaaaacttcaaaagtgaggttacagagacatcagagaacagtcaactcggtgagcttgtgctcaagtggctcaaggaggacctgtcggccagaggaccgaggaacgggcaatccagccagagcaagacctacgggtcactggacggacttgggggatatgggctggagaagccaacctga

SEQ ID NO: 184 - protein, 280 aa, Aspergillus fumigatus
  Aspergillus fumigatus Af293
MADSDNHTGPSINVNGLNYKFPDGSSGLTNVSLSLPAGSRTLLIGANGAGKTTLLRLLAGKRLAPTDTVSVSGRDPFKHGLEGVTYLGVEWVLNSIVRTDIDVPTLLASVGGDAYPERRDELVEILDIDLRWRMHAVSDGERRRVQLAMGLLRPWQVLLLDEITVDLDLLSRSNFLSFLKRETETRPCTIVYATHILDNLSQWPTHLVHMHLGNVRQWGPMENFKSEVTETSENSQLGELVLKWLKEDLSARGPRNGQSSQSKTYGSLDGLGGYGLEKPT

SEQ ID NO: 185 - DNA, 1668 bp, Ustilago maydis
  Ustilago maydis 521
  CDS (1)..(1668)
atgcctggatacaccgactcgatatgtgtcttttgcggctcctcgcctggcgtcaagcccgaatacatggcggccgcagctagcgtcggccacgccattgccaggcacaactaccgtctcgtctatggaggtggttcgcgcggctgcatgagcggtgtctcccaagctgtccttgaagtaggcggtcacgtcctcggcgtcatcccccaagtcatggccgccaccgtccctgcgggtcatcctggacaaaatctggcggcccccaaggtcgtctccaaggaaggtgtcggccctaccgtgctcaatcccgacgcaggcacaggtcatatcgaaaccatcgtcgtccagtccatgcacgaaaggaagcagcgcatggctgccgaaagcaacctcggctttattggccttcctggtggatacggcactttcgaagaggtcatggagatggtcacttggacccagcttggtatccaccgaaagcccatggttctgctcaacgtcaacggcttctacacccccatcaagcagcaaatcgagcttgctgtcgaggacggcttcatcgccaaggatggaaagcagctcatcagctttgtcgagtgcgacgcttccaacattgatgcctgcggtgataaggtgctcgcggaagcagttcgcctctccaacgagcttgcttcaaatggctggggctactgggactggaacaagcctcagggacccatcagtaccgccaaaggtggcatcagcgacaacgctgctaacaagtctctcgaactcgctgacggcgaaacgctcgctgtacaagtgtccgacctgactttcaccttcaacccggacatgccacctgcgctcgaacactgcaatctcagcctgaagcgtggctcgcgctgtcttcttatcggtgccaacggtgctggcaagtcgacactcttacgtctgctcgccggcaaaaagctgtgcgactccaaggtgcgcgtgtttggcaaggatgtcttccgcgagtctccttccggcgttacgtatctcggcaccgagtgggccatgaatccggttgtgcgctctgacattgtcgtctccgctttcctcgattcagtcggcggctaccgtcacaaggcgcgtcgcgatcgtctgctcgacattcttgatgtcgatctcacgtggcacatgcacgccatctcggatggtgaacgacgacgtgttcagctgtgcatgggtctcatggagccctgggacctgctcctgctcgacgaagtgactgtggatctggatgtccaagttcgcgcggatctgctcgactttctgcagcaagagaccgaggagaggcatgcgaccatcatctacgccactcacatctttgacggattgcagagcttccccactcatctggctcatatgcggctgggaacgactacgaccactttgccgatcgattggcctgccaccaacgcggctgatatcgcggcgctgccacccactgcggctgctgacaagaccagagacctgtcgccattgctcaacgtctcgctcgcttggttgagagaggacaaggtggtgcgcgccgagcaagaggctaagcgcggcagagtcagaggtgccaaccgccaaaacgagaccaccgactcggagaaattcttcagcaagtatgattactcgcagtcagtcacacgctag

SEQ ID NO: 186 - protein, 555 aa, Ustilago maydis
  Ustilago maydis 521
MPGYTDSICVFCGSSPGVKPEYMAAAASVGHAIARHNYRLVYGGGSRGCMSGVSQAVLEVGGHVLGVIPQVMAATVPAGHPGQNLAAPKVVSKEGVGPTVLNPDAGTGHIETIVVQSMHERKQRMAAESNLGFIGLPGGYGTFEEVMEMVTWTQLGIHRKPMVLLNVNGFYTPIKQQIELAVEDGFIAKDGKQLISFVECDASNIDACGDKVLAEAVRLSNELASNGWGYWDWNKPQGPISTAKGGISDNAANKSLELADGETLAVQVSDLTFTFNPDMPPALEHCNLSLKRGSRCLLIGANGAGKSTLLRLLAGKKLCDSKVRVFGKDVFRESPSGVTYLGTEWAMNPVVRSDIVVSAFLDSVGGYRHKARRDRLLDILDVDLTWHMHAISDGERRRVQLCMGLMEPWDLLLLDEVTVDLDVQVRADLLDFLQQETEERHATIIYATHIFDGLQSFPTHLAHMRLGTTTTTLPIDWPATNAADIAALPPTAAADKTRDLSPLLNVSLAWLREDKVVRAEQEAKRGRVRGANRQNETTDSEKFFSKYDYSQSVTR

SEQ ID NO: 187 - DNA, 1491 bp, Trypanosoma cruzi
  CDS (1)..(1491)
atgagccacacattcacggacccgctggtggatctcgcatccgtctcctttcagtacccacatggcggcggcggttcggcgggcggaatacgcgatgtcagtgttcgcgtgaatggcggggatcgagttctcgtcgtggggcacaacggtagtggaaagtcaacgcttctgtccgtcattgcggggcggcgaaaggcgtcgagtggccgcgccactgtgctgggttccgacgcctttgatgacacgcgtctgcagcagcatgtgacgcttattggtcgaccgtggccaacagaggctttctttgccaccactgtcgaccaggtaacctctcaggcgccgctgccggaaaggaagcgaagcgtggcggatgctcttcatcttgatttagggcgtgccgttagcaatatgagttcgggggagagacggcgggtgcagattcttcacggtttgttgcagaagtcgtttgtttatttgctggacgaatgtagcacggacattgacattgcggagcgaatgaccgtgttggatcttgtgcggtcagagtgtgttgttggtgacagctgttgcttgtatgcgacccatatttttgatggtgtgagtgactgggcaacgcacctcttgctgatgcagggaggcatggtcgttgatttcaaaagggtatctgatctcaatgcacctttggaggtgtttgtgtgccacttcctcacgaggcgtcatcgaggcctttttgatcacactagcaagcggacgcccgtgaaagacgcatacaatgacgattggaagggagggggcacagtgaccgccttgcccttggaaaaagaggctgttattgtttgtgaccgactacaatacagaaacatattccgtaatctttccttcacggtttacaggggggatcgtgtgttgctctgtggttgcaatggtgccgggaagtcgactttgctgaaaatgatgggcgggaagcagttcttcaacaactgcaatggatcactccgtattcttgggaaatcctgttacgatgatatgacgctaaacggccttgttgcgtttggtggtgaatggtgggataccgcaccgccgggtgaaatgcacgtgcacgagatgctgcaacttcaaacaccacgggcagagtggttgtgcaaagttcttggagtggacttgtcgtgggacgtccgccatatttctacgggtgagcagaaacatgtgcagcttctacttcacttactcgaggacaagccagttattctgctggatgaggccacatctgatcttgatctcgaccagcgacaggagttgttatcatttctgtacagtgagagcgtcaaccgaggtgtgactgttgtgtacgcaactcacatatttggcgggctggagaattggccaacagccgtcatgatgcttgaccggaccacgcaaggcctccatgccatgtggtgtggaagcgatgtgaaatgggcagaagttacaagggagcttatcgctttaaagtga

SEQ ID NO: 188 - protein, 496 aa, Trypanosoma cruzi
MSHTFTDPLVDLASVSFQYPHGGGGSAGGIRDVSVRVNGGDRVLVVGHNGSGKSTLLSVIAGRRKASSGRATVLGSDAFDDTRLQQHVTLIGRPWPTEAFFATTVDQVTSQAPLPERKRSVADALHLDLGRAVSNMSSGERRRVQILHGLLQKSFVYLLDECSTDIDIAERMTVLDLVRSECVVGDSCCLYATHIFDGVSDWATHLLLMQGGMVVDFKRVSDLNAPLEVFVCHFLTRRHRGLFDHTSKRTPVKDAYNDDWKGGGTVTALPLEKEAVIVCDRLQYRNIFRNLSFTVYRGDRVLLCGCNGAGKSTLLKMMGGKQFFNNCNGSLRILGKSCYDDMTLNGLVAFGGEWWDTAPPGEMHVHEMLQLQTPRAEWLCKVLGVDLSWDVRHISTGEQKHVQLLLHLLEDKPVILLDEATSDLDLDQRQELLSFLYSESVNRGVTVVYATHIFGGLENWPTAVMMLDRTTQGLHAMWCGSDVKWAEVTRELIALK

SEQ ID NO: 189 - DNA, 948 bp, Picrophilus torridus
  Picrophilus torridus DSM 9790
  CDS (1)..(948): transl_table=11
atggaattattaaaatctggggaacaacctgattatgcagtttacgcaaaggatgttgtgttctcatatgataataaaaagaacgttgtggatcatctaacattttcagtaaaaaaaggcgagatctttggtctgcttggtccaaacggtgctggcaaaacaacaacaattaaattaatgaccacgcttttaaggccggtttcaggtgaattaaggatacttggcatggattacaggtcaggcaataggttaagatcaaggcttggcgttgttcttcaggatgaatcctttgattttacaacggttgaaagggcccttgatatatatggatacatatggggtgttccgaggaatataagaaagaagcgtgtaaatgatttactggaaaaatttgatctctacgattttagaaataagaggatgtgggacctttcaggaggccagaagagaagggtccaggttgcaagggagttcatgcatgatatggacctattattcctggatgagcctacaacaggtcttgatccaatatcaagaagaaagatacttgacatgataaaagatatgtcaagaaatggtcttaccgttatatttacaacgcacatacttgaagaggccgattacgtctgcgatagaatagcaataatgcgctccggcaaaattgttgcaatggataaaacagaggaattaaaaaagaggtatgcaggggcaaaaaccatagagatatcattgagcaaaaacagggacagggttctctcaatgataagcacaggtgaggtctcatctgatgatgataatgatataatagttacaaaggatgttaataaaacgatatcagagatcaccgagttaataaagcggtttgatgcatctcttgaatacataaatgtaagatctgtttcccttgatgatgtgttctttaatacaataaacggtgaggtatcatga

SEQ ID NO: 190 - protein, 315 aa, Picrophilus torridus
  Picrophilus torridus DSM 9790
MELLKSGEQPDYAVYAKDVVFSYDNKKNVVDHLTFSVKKGEIFGLLGPNGAGKTTTIKLMTTLLRPVSGELRILGMDYRSGNRLRSRLGVVLQDESFDFTTVERALDIYGYIWGVPRNIRKKRVNDLLEKFDLYDFRNKRMWDLSGGQKRRVQVAREFMHDMDLLFLDEPTTGLDPISRRKILDMIKDMSRNGLTVIFTTHILEEADYVCDRIAIMRSGKIVAMDKTEELKKRYAGAKTIEISLSKNRDRVLSMISTGEVSSDDDNDIIVTKDVNKTISEITELIKRFDASLEYINVRSVSLDDVFFNTINGEVS

SEQ ID NO: 191 - DNA, 984 bp, Picrophilus torridus
  Picrophilus torridus DSM 9790
  CDS (1)..(984): transl_table=11
atggagaatataatagagactaagaatttaacaaagatttataaaaatttaagggccgtcgataacttaaacatgaccgttagaagtggcgagatcttcggccttttaggtcagaatggtgccggcaagacaacaacgataaagatgctaacaaccataataaaaccaacgtcagggactgccatagttgatggccacgacattgtaaaggaatcgatgaaggttcgcgattcaataggtatagtgccgcaggaactgacaacagatgaggatctatcaggctatgagaatttaatgctgatagcagatttttataatataaaaaagagcgatgcaagggccaaggcacttgaacttttaaagatggttgatcttgaggatgcggcaaggaggcctgtttcaacctattcaggaggcatgaggaagcgtattgaattaatagcaggtcttgtccacagtccaaaggtattattccttgatgagccaacccttggtcttgatgtccagacaaggacaaacctctggtcatatataaaagcaataaaggaaaaccttgggataacaataatattaacatcgcattatcttgaggaggtcgacgcacttgcagatcatatagcaattatagaccatggaaggctattaaaggttggcacatcagaggaattaaaggaaggccttggcggggacataatatcaatggaattgaacagtgaatcagaggttaatcttttaaaggacttccctgcaaaggagacaagcataaatggaagcagtataaggttcaaggttgagaattctgatgcaatccttcctgaattaatggatatattatacaggaatcatatatggcccaggaagatgaccgtggaaaagccatcacttgatgaggcgtttcttgaatacaccggcaggaagataaatgatgaaacgccaatggattatggaaagacaatgaattatatgaggaggataagcagatga

SEQ ID NO: 192 - protein, 327 aa, Picrophilus torridus
  Picrophilus torridus DSM 9790
MENIIETKNLTKIYKNLRAVDNLNMTVRSGEIFGLLGQNGAGKTTTIKMLTTIIKPTSGTAIVDGHDIVKESMKVRDSIGIVPQELTTDEDLSGYENLMLIADFYNIKKSDARAKALELLKMVDLEDAARRPVSTYSGGMRKRIELIAGLVHSPKVLFLDEPTLGLDVQTRTNLWSYIKAIKENLGITIILTSHYLEEVDALADHIAIIDHGRLLKVGTSEELKEGLGGDIISMELNSESEVNLLKDFPAKETSINGSSIRFKVENSDAILPELMDILYRNHIWPRKMTVEKPSLDEAFLEYTGRKINDETPMDYGKTMNYMRRISR

SEQ ID NO: 193 - DNA, 900 bp, Bacillus anthracis
  Bacillus anthracis str. Sterne
  CDS (1)..(900): transl_table=11
atggaaaagattattgaagtaaatagtgtttctaaaacatttaaacataaaaaagcagtaaataacgtttcatttcatgtgaataaaggagaaatcgtagcactacttggaccaaatggtgcaggaaaaacgacgatgtcgatgatgcttggattaaaggatccgacggaaggaacggtttctatatttggaaagaatccaaagcatagagatgttcgtaatagcctaggtgcgatgttacaggaagtaagtgtcattgatagcattacagtggaagaggcaattgaattattccgtagttattatacgaatccggtagcgaaagaaacgttactacagttatcaaatttagaattggagcgaaagcaaagatgtgagaaattatcaggtgggcaaaaaagaaggttaaactttgcactcgcacttgcaggaaatccagacttgttatttttagatgagccgacagttggaatggatattacgtctcgaagaacgttttgggaaacaattcgaaaattagtaagtgaagggaaaacaattattttaacaacgcactatttagaagaagcagatgcattggcagatcgtattttactgtttgtgaatggaaagattatcgcagatggtacaccagatgagatgaaagcaacgatttcacgaaaaacgatttcgttttattcgaaggaaagtataccggcaaaattactaaaagaattaccaaacgtaacagaagtacaagcaaaagaagggcacttcactttaacaactgaagatacagatgcaacgttaaaagcaatttatcaaaagaacttacctgtaacagatgtttctgttgaacgtggaagtcttgatgaagcatttgaacagtttgtcgcaaatcagaaggaggaaatcgcatga

SEQ ID NO: 194 - protein, 299 aa, Bacillus anthracis
  Bacillus anthracis str. Sterne
MEKIIEVNSVSKTFKHKKAVNNVSFHVNKGEIVALLGPNGAGKTTMSMMLGLKDPTEGTVSIFGKNPKHRDVRNSLGAMLQEVSVIDSITVEEAIELFRSYYTNPVAKETLLQLSNLELERKQRCEKLSGGQKRRLNFALALAGNPDLLFLDEPTVGMDITSRRTFWETIRKLVSEGKTIILTTHYLEEADALADRILLFVNGKIIADGTPDEMKATISRKTISFYSKESIPAKLLKELPNVTEVQAKEGHFTLTTEDTDATLKAIYQKNLPVTDVSVERGSLDEAFEQFVANQKEEIA

SEQ ID NO: 195 - DNA, 903 bp, Bacillus thuringiensis
  Bacillus thuringiensis serovar konkukian str. 97-27
  CDS (1)..(903): transl_table=11
atggaaaagattattgaagtaaatagtgtttctaaaacatttaaacataaaaaagcagtaaataacgtttcatttcaggtgaataaaggagaaatcgtagcactacttggaccaaatggtgcaggaaaaacgacgacgatgtcgatgatgcttggattaaaggatccgacggaaggaacggtttctatatttggaaagagtccaaagcatagagatgttcgtaatagcctaggtgcgatgttacaggaagtaagtgtcattgatagcattacagtggaagaggcaattgaattattccgtagttattatacgaatccggtagcgaaagaaacgttactacagttatcaaatttagaatcggagcgaaagcaaagatgtgagaaattatcaggtgggcaaaaaagaaggttaaactttgcactcgcacttgcaggaaatccagacttgttatttttagatgagccgacagttggaatggatattacgtctcgaagaacgttttgggaaacaattcgaaaattagcaagtgaagggaaaacaattattttaacaacgcactatttagaagaagcagatgcattggcagatcgtattttactgtttgcgaatggaaagattatcgcagatggtacaccagatgagatgaaagcaacgatttctcgaaaaacgatttcgttttattcgaaagaaaaaattcctaagagtttactaaaggaattgccgaatgtaacagaagtacagtcaaatgaaggacgtttcatcttaacaactgaggataccgatgcaactttacaagcgatttataaaagaaatttacctgtaacagacgtttctgttgaacgtggaagtcttgatgaagcatttgaacagtttgtcgcaaatcagaagggagaaatagcatga

SEQ ID NO: 196 - protein, 300 aa, Bacillus thuringiensis
  Bacillus thuringiensis serovar konkukian str. 97-27
MEKIIEVNSVSKTFKHKKAVNNVSFQVNKGEIVALLGPNGAGKTTTMSMMLGLKDPTEGTVSIFGKSPKHRDVRNSLGAMLQEVSVIDSITVEEAIELFRSYYTNPVAKETLLQLSNLESERKQRCEKLSGGQKRRLNFALALAGNPDLLFLDEPTVGMDITSRRTFWETIRKLASEGKTIILTTHYLEEADALADRILLFANGKIIADGTPDEMKATISRKTISFYSKEKIPKSLLKELPNVTEVQSNEGRFILTTEDTDATLQAIYKRNLPVTDVSVERGSLDEAFEQFVANQKGEIA

SEQ ID NO: 197 - DNA, 795 bp, Yersinia pseudotuberculosis
  Yersinia pseudotuberculosis IP 32953
  CDS (1)..(795): transl_table=11
ttggacctacaggcaagccactccagcacttttatactccgtgaactgagtttttcggttcctggtcgaaccttattacagccgctgtcactgacgtttccgcaagggaaagtctgtgggttgatcggccataacggttccggtaaatcgacattgctaaaaatgctgggccgtcatcaaccaccatcaagtggtcaggttgtgctcaacgatatgccactggcccaatgggatagcaaagcgtttgcccgcgaagtggcctatttaccgcagcaattaccggccgcagaagggatgacggtgcgtgaattagtcgccatcggccgctatccgtggcatggcgcgctagggcgctttcgtcaggaagatcgccaacaagtcgaagaggcgattgcattggtagatttgaaaccactggctaaccgcctggtggacagcttgtctggcggtgagcggcagcgggcttggttggcgatgatggtggcgcaaaacagccgctgcctgctgctggatgagcctacctccgcgctggatattgctcatcaggtggaggtcttggggctaattcaacgtctcagccacgagcgtggcctaaccgtaattgccgtgttacacgatatcaatatggcggctcgttattgtgaccatctcgtggcattgcggggtggtgagatgatcgcccaaggcccggcagatagcctgatgcagagtgcggtattagaacaaatttatggtatcccgatgggcattttaccgcacccggctggcggtgcgccggtaagttttgtttattaa

SEQ ID NO: 198 - protein, 264 aa, Yersinia pseudotuberculosis
  Yersinia pseudotuberculosis IP 32953
MDLQASHSSTFILRELSFSVPGRTLLQPLSLTFPQGKVCGLIGHNGSGKSTLLKMLGRHQPPSSGQVVLNDMPLAQWDSKAFAREVAYLPQQLPAAEGMTVRELVAIGRYPWHGALGRFRQEDRQQVEEAIALVDLKPLANRLVDSLSGGERQRAWLAMMVAQNSRCLLLDEPTSALDIAHQVEVLGLIQRLSHERGLTVIAVLHDINMAARYCDHLVALRGGEMIAQGPADSLMQSAVLEQIYGIPMGILPHPAGGAPVSFVY

SEQ ID NO: 199 - DNA, 720 bp, Bacillus licheniformis
  Bacillus licheniformis ATCC 14580
  CDS (1)..(720): transl_table=11
atgatgagtacaattctactggaaacaaggcatcttcaaaaaaagttcggaagatcgcaagcggtctcagacgtctcattgtcagttgaaaagaacagtatttacggattgcttggaccgaatggagcaggaaaatcaacgactttaaaacttttaaccggaatcttaaacccaactgccggggatattttgtttgaggggcggcaatggaaaaggtccgtattaaaagacatcggttctttaatagaatccccgcctctgtatgataatttaacagcctacgagaatgccaaggtgcatgccgcattattgggccttccagatgcgagaataacagaggtgcttaaaactgttgatatgcatcataccggaaagaaaaaggcggggcagttttctatggggatgaggcagaggctggggatcgccatcgctcttttaaatcgccctaaactactcatacttgatgagcctactaacggtcttgatccgatcggtatacaagagttgagggaactcatcaggtcatttcccgaacaggggatgacggtcattttatcaagccacattttatcggaagtcgagcagatcgcagaccatatcgggattatcagcggagggtatctcggatatcaggggaaaatcaataagggagacgatcttgagcggctttttatggatgttgtcaaatcaacgcgggagaaagagggcggagaaaagtga

SEQ ID NO: 200 - protein, 239 aa, Bacillus licheniformis
  Bacillus licheniformis ATCC 14580
MMSTILLETRHLQKKFGRSQAVSDVSLSVEKNSIYGLLGPNGAGKSTTLKLLTGILNPTAGDILFEGRQWKRSVLKDIGSLIESPPLYDNLTAYENAKVHAALLGLPDARITEVLKTVDMHHTGKKKAGQFSMGMRQRLGIAIALLNRPKLLILDEPTNGLDPIGIQELRELIRSFPEQGMTVILSSHILSEVEQIADHIGIISGGYLGYQGKINKGDDLERLFMDVVKSTREKEGGEK

SEQ ID NO: 201 - DNA, 918 bp, Nocardia farcinica
  Nocardia farcinica IFM 10152
  CDS (1)..(918): transl_table=11
atgtccgaggtcatccgaatccgggacctgcgcaagacgttcggccatgtcaccgccctcgacggcctggacctggaggtcgccgaaggcgagatccacggcttcctcgggcccaacggcgcgggcaagtccaccaccatccgcattctgctcggcatcctgcgggccaccgcggggcaggccgaactgctcggacgcgacccgtggaccgacgcggtggagctgcaccgcgaactggcctatgtgcccggcgatgtcacgttgtggccttcgctcagcggcggcgagaccatcgacctgctggcccgcatgcgcggcgggatcgaccgtgcccgccgggacgaactgatcgaacggttcgatctggacccgcgcaagaaggcccgcacctactccaagggcaaccgccagaaggtcgcgctcgtctccgcgttcgcctccgacgtgcgcctgctgctgctcgacgagccgacctcgggcctggacccgttgatggagcagctgttccgcgactgcgtgcgcgaggcggccgcgcgcggcaccaccgtgctgctgtccagccacatcctgtccgaggtggaggcgctgtgcgaccgggtgaccatcatccgggccggccgcacggtggagagcggctcgctcgccgacctgcgccacctctcacgcacctcgatcaccgccgaattgctcggtgacccgggcgatctgagccgcatcgccggggtcgacgacatcgagcgcgacggcgacacgctgcgctgccaggtcgacagcgaacacctcggcgagctgatccgggtgctcggcgacaccggtgtgcgcagcctcaccagcgctccgccgacgctcgaggagctgttcctgcggcactaccacgtcgacggcgccgacgaggccggacaggtggtgcgggcatga

SEQ ID NO: 202 - protein, 305 aa, Nocardia farcinica
  Nocardia farcinica IFM 10152
MSEVIRIRDLRKTFGHVTALDGLDLEVAEGEIHGFLGPNGAGKSTTIRILLGILRATAGQAELLGRDPWTDAVELHRELAYVPGDVTLWPSLSGGETIDLLARMRGGIDRARRDELIERFDLDPRKKARTYSKGNRQKVALVSAFASDVRLLLLDEPTSGLDPLMEQLFRDCVREAAARGTTVLLSSHILSEVEALCDRVTIIRAGRTVESGSLADLRHLSRTSITAELLGDPGDLSRIAGVDDIERDGDTLRCQVDSEHLGELIRVLGDTGVRSLTSAPPTLEELFLRHYHVDGADEAGQVVRA

SEQ ID NO: 203 - DNA, 792 bp, Thermococcus kodakarensis
  Thermococcus kodakarensis KOD1
  CDS (1)..(792): transl_table=11
atgaaagcggttgaagccgagaatttaacgatcttatacagcgggcagccagccctgagcgatgtaacgttcaccctggaggaaggaaaaacactgctcctcctcgggccaaacggtgcggggaagacgaccctactgaagactatagcatgctttcacagagagtacactggggagctcagagtatttgagagaccaccctgcgaggcgagagagcttataggctatgttccccaaagccagagtctaaacgagagagttcccctaacggcgcttgaagtcgttgccatgggcggtgtttacaggaagggcttcgtccacttcaggatacccggagaggtaatagaaaaagccgaaaaagtcctggagttcgtcggtctcgggggaattggggacaggctcttccgcgagctctccggcgggcagaagcagagggttctcctcgcgagagcactgatgagcgatccaaggctgctcctacttgacgagccgctttcggcactcgacccaagcgcgagggcagaggttgccaacgttctggataagataaagcgggaaaagggagtgacgatgataatcacgacacacgacatcaacccgctcctcgagataggggatctcgtgatgctcataaacaggaggctgatagccttcggcaggcctgaggaagtgctcactgacgaagttataaagtctgtctacggcccgatggcaaaggtgatcccggtcggcggaaaagtctactgcataaccggggacttccacatccaccgcgggggtgagaaaatatga

SEQ ID NO: 204 - protein, 263 aa, Thermococcus kodakarensis
  Thermococcus kodakarensis KOD1
MKAVEAENLTILYSGQPALSDVTFTLEEGKTLLLLGPNGAGKTTLLKTIACFHREYTGELRVFERPPCEARELIGYVPQSQSLNERVPLTALEVVAMGGVYRKGFVHFRIPGEVIEKAEKVLEFVGLGGIGDRLFRELSGGQKQRVLLARALMSDPRLLLLDEPLSALDPSARAEVANVLDKIKREKGVTMIITTHDINPLLEIGDLVMLINRRLIAFGRPEEVLTDEVIKSVYGPMAKVIPVGGKVYCITGDFHIHRGGEKI

SEQ ID NO: 205 - DNA, 927 bp, Gluconobacter oxydans
  Gluconobacter oxydans 621H
  CDS (1)..(927): transl_table=11
atgcaagaccgaaacattctgcaccccgccgccccttcgtccctgcctgtggaggtctcgcacctcaccaagagcttcgggagcttccgggcactggatgacgtctccttctccatcgcgcagggcgaaaccgtagcccttctgggacgcaacggggcgggcaaatccacgctgatcggatgcctcatgggcttcctgctcgcggatggcggcagcatcgacattttcggtcacagcatcgcggccctcccccgcgaaatccgggcacggacaggcttcgtgccccagaccatgaccggtttcggcagcttccgcgtcgcccagctcatggactacatcgcagcgttctacggcgaacttccccccgtcgatccggccctgatcgcctgggccgacctcgatccgaaaaagcaggtgcgctccctgtccggcggccagaaacagcgtctggccatcgcgctcgccatgcgtcacaaccccgaattcctggttctggacgaacccgtcgccagtctggacccccatgcccggcgcgatttcatgaacctgctcgatacctacacgcagcggaccggcgccagcatcctgatctcgtcgcatatcctgtccgatctcgaacgcctgtgctcgcgcctgctcttcgtccggcaaggacatgtcgtgctcgacgtcccgaccgagaccttccgcaccaccacgcgctggctcgaacatcccacgcccgaccggctcctcgccgccctgcccgccgatctccagatcctcggccagcgtcccgatgcgctgctggtgcatggctggaccggagacctgatccttcccgaaggcaccctgacggtcatcccggatttcgaagacgccttcctggaaatcacggcgccccgcacttcccccgctgacaccgacaccccggacgccgcggcatga

SEQ ID NO: 206 - protein, 308 aa, Gluconobacter oxydans
  Gluconobacter oxydans 621H
MQDRNILHPAAPSSLPVEVSHLTKSFGSFRALDDVSFSIAQGETVALLGRNGAGKSTLIGCLMGFLLADGGSIDIFGHSIAALPREIRARTGFVPQTMTGFGSFRVAQLMDYIAAFYGELPPVDPALIAWADLDPKKQVRSLSGGQKQRLAIALAMRHNPEFLVLDEPVASLDPHARRDFMNLLDTYTQRTGASILISSHILSDLERLCSRLLFVRQGHVVLDVPTETFRTTTRWLEHPTPDRLLAALPADLQILGQRPDALLVHGWTGDLILPEGTLTVIPDFEDAFLEITAPRTSPADTDTPDAAA

SEQ ID NO: 207 - DNA, 981 bp, Gluconobacter oxydans
  Gluconobacter oxydans 621H
  CDS (1)..(981): transl_table=11
atgcagacgcccccttccccttccgacgccattacggtcagcaatctccgcaaaacctaccggatccgcgaaggaggcagctggcgggggaaaacccgtgatatcgtcgcgctggacgggatttccttttcggtcccgaaaggccagatcgcaggcttcatcggcccgaatggcgcaggaaaatcgacggcgatcaagatcctctccggcatcctgcgccccacgtcgggagaggtgcaggtcaatgggctggtgccctggacaaaccgcatcgcccatgtggcgcggatcggcgtcgtgttcgggcagcggacccagctctggtgggatctttcggtcgccgaaggcctcgccttgctgcgcgacatctacggcgtggaaccggagcgttttacccgcaaccgcgcccgtctggccgatgcgctcgatctgggcgcgatcatggaccagtccgtacgccagctttcgctcggacagagaatgcgtgccgaaatcgcggcctctctcatccatgatccggacatcctcattctggatgaacccacgatcggtctggatgcaccctccaagctcgccgtgcgggctttcgtgcatgaactctgccgggaccggggcaccaccgtcctgctgacgacccacgacatgcacgatatcgaggcactcgccgaacgtgtgatcgtcatcggtcacggtcgtatcctcgcggacagcccgttcgaagacctccgcaccacgacgctgtccgagcgtattctggaactcgatttccatgacacgcctcctgaactgacgcttcccgccggcgcccacgaaaccgcgcgcgagccccacagcctcaccatcactttcgacccgagccagatcccggccccggccctcgtcgcgcatgtcggccatttgcccggcctcgacgacctgcggatcagccgtccttcaatcgacgagatcatcacacgtttctatgcggatcacgccgcatga

SEQ ID NO: 208 - protein, 326 aa, Gluconobacter oxydans
  Gluconobacter oxydans 621H
MQTPPSPSDAITVSNLRKTYRIREGGSWRGKTRDIVALDGISFSVPKGQIAGFIGPNGAGKSTAIKILSGILRPTSGEVQVNGLVPWTNRIAHVARIGVVFGQRTQLWWDLSVAEGLALLRDIYGVEPERFTRNRARLADALDLGAIMDQSVRQLSLGQRMRAEIAASLIHDPDILILDEPTIGLDAPSKLAVRAFVHELCRDRGTTVLLTTHDMHDIEALAERVIVIGHGRILADSPFEDLRTTTLSERILELDFHDTPPELTLPAGAHETAREPHSLTITFDPSQIPAPALVAHVGHLPGLDDLRISRPSIDEIITRFYADHAA

SEQ ID NO: 209 - DNA, 858 bp, Ralstonia eutropha
  Ralstonia eutropha JMP134
  CDS (1)..(858): transl_table=11
atgccacagatcctagtcagtcaactgcgcaagacataccgtatccacgaacgcgatccgggcgtgctcggcgcgctgcgcgcgctggttcgcccacgctatcgcacggtcgaggcactggctggtgtgtcgttcgaactggagcgcggcgaactgctcggcttcatcggtccgaatggcgcaggcaaatcgacgaccatcaagatcctctcgggtatcctgcggcccgatagcggccgtgtcgaagtcaacggccgcgttccgttcgacgaccgcgagcgccatgtcgcccgtatcggcgtggtattcgggcagcgtacgcagctctggtgggatctgccggtcggcgacgggttcgcactgttgcgcgatatctaccggctcgacccggttcgctttggccgcacgcgcgacgagttggtggcgctgttgaatctcgaacgactgctcgaccagcccgtacgccagttatcgctaggccaacgcatgcgcgccgagatcgcggccgccctgctccacgagcccgacatcctgttcctcgacgagccgaccatcggcctcgatgccccgtccaagctcgcagttcgcgactttatccggcgtgccaaccgggagcgcggcaccacggtgctgctgaccacgcacgacatgcacgacatcgaggcactcgcacggcgggtgatcgtgatcggccacggacgcgtgctggcggactgcgacgtcgaggccttgcggcagcaggtgctggccgcacgccgtctcgatgatggcctgcccgacgacgcagaagacgagggcatggccatcgaagccgtcatcgcgcgcttctacgcgatgcacggcgcagcggaggcttga

SEQ ID NO: 210 - protein, 285 aa, Ralstonia eutropha
  Ralstonia eutropha JMP134
MPQILVSQLRKTYRIHERDPGVLGALRALVRPRYRTVEALAGVSFELERGELLGFIGPNGAGKSTTIKILSGILRPDSGRVEVNGRVPFDDRERHVARIGVVFGQRTQLWWDLPVGDGFALLRDIYRLDPVRFGRTRDELVALLNLERLLDQPVRQLSLGQRMRAEIAAALLHEPDILFLDEPTIGLDAPSKLAVRDFIRRANRERGTTVLLTTHDMHDIEALARRVIVIGHGRVLADCDVEALRQQVLAARRLDDGLPDDAEDEGMAIEAVIARFYAMHGAAEA

SEQ ID NO: 211 - DNA, 975 bp, Magnetospirillum magnetotacticum
  Magnetospirillum magnetotacticum MS-1
  CDS (1)..(975)
atgatcaccatcgaaaatctcagccatacctatccgggcgcgcgcaagatgccgccccggacggccatctcggatctgacccttgaggtcgcggacagggaattcgtcattctctccggccctaacggcagcggcaaatccaccttgttccgcatcctgtgcggcatgacattgccgggcaagggcaaggtcgtcgtcggtggcttcgacctgttcgcccaaccggcacgggtgcgcgaaatcatgggtgtggtcttccaaagcccggccgtggacaagcatctgtcggtgggagagaacctgaagatccacgccgatctctatgggatcaccggcgccgactatatccgccgccgtgacgagggcctaagctggaccgatctggatggccgcctggaccagaaggtcgcgaccctgtcgggcggtctggcgcggcaggtggaactggccaaggttctgatgaccgagcccaagatccttctgctggacgagcccaccaccggactcgaccccatgagccgccgcaattttctgaccgcgctgcaccgcttgcagaaagagcggggcatgaccgtgctgatgaccagccacgtcttctccgaggccgacgacgtggaccgtgtcgccatcatgcgcgagggcaagctgctggcctatgacacccccgccgcgctcaaagccatgatcggcaccgagatggtggtggttcaggccaagaacgccgaagccctggccgagcgtctgcgcgccgagatgggcctggccgtgcgctgcatcggcgacgaagtgcggctggaggagaccgagaacggcgaaagcctgccgcttttggaacgtatcctggaccgcttccgcgccgatatcggctccatcgccatcaagcagcccggcctggatgatgtcttcgtccatgtcaccagcaaggcggtccccgaccatgccttggctttggaattgcggaaggccgcatcatga

SEQ ID NO: 212 - protein, 324 aa, Magnetospirillum magnetotacticum
  Magnetospirillum magnetotacticum MS-1
MITIENLSHTYPGARKMPPRTAISDLTLEVADREFVILSGPNGSGKSTLFRILCGMTLPGKGKVVVGGFDLFAQPARVREIMGVVFQSPAVDKHLSVGENLKIHADLYGITGADYIRRRDEGLSWTDLDGRLDQKVATLSGGLARQVELAKVLMTEPKILLLDEPTTGLDPMSRRNFLTALHRLQKERGMTVLMTSHVFSEADDVDRVAIMREGKLLAYDTPAALKAMIGTEMVVVQAKNAEALAERLRAEMGLAVRCIGDEVRLEETENGESLPLLERILDRFRADIGSIAIKQPGLDDVFVHVTSKAVPDHALALELRKAAS

SEQ ID NO: 213 - DNA, 939 bp, Bacillus cereus
  Bacillus cereus G9241
  CDS (1)..(939): transl_table=11
atgaatactttagaaattaaaaatttaacgaaaaaatttggtgatttcatcgcagttgataatatgtctttatctattaaagaaggagaaatatttggctttttaggatcgaatggtgctggtaagagtacgacaatcaacatgattgctggtttgttaagaagtaatgaaggtgaaattagcatactaggaaaaaatataaagaaacataatcgatttgcgaagatgaatatcggtatcgttccgcaagatattgcaatttatgaagagttaacagcttatgaaaatgtgaaattctttgctggattgtacggattacgaggagctgaattaaaagctagggtcgaggaagctcttcaatttgtaggacttagcgataaacagaaaagctatccaaagaacttttctggtgggatgaagcgaagactgaatatcgcttgtgcaattgctcatagaccgaagttaattattatggatgagccgacagttggaattgatccacagtcaagaaattatatcctgcagtctgttcggaaattaaacgaaatgggaagtacgattatttatacgagtcactatatggaagaggtagaagagatttgtacgaaaatagcgatagtagatcacggtaaagtgattgcagaaggaacgaaagagcagttaaaagcgattattactgatacgaaagatatttggattgaagtgaaatcggtagagaatttagatgtagaaaaattaaaagagataaacggtgtgaaagctgttcaaattgaagagaacgtaattaaagtaaattctgatgcaggattaaataatttaaataaaattgttcagcacttcatcaatcatgacattgaaatccgttcgttagaggagcaggctcctaacttagaaacggtattccttacgttaactggaagaaacttacgagataaataa

SEQ ID NO: 214 - protein, 312 aa, Bacillus cereus
  Bacillus cereus G9241
MNTLEIKNLTKKFGDFIAVDNMSLSIKEGEIFGFLGSNGAGKSTTINMIAGLLRSNEGEISILGKNIKKHNRFAKMNIGIVPQDIAIYEELTAYENVKFFAGLYGLRGAELKARVEEALQFVGLSDKQKSYPKNFSGGMKRRLNIACAIAHRPKLIIMDEPTVGIDPQSRNYILQSVRKLNEMGSTIIYTSHYMEEVEEICTKIAIVDHGKVIAEGTKEQLKAIITDTKDIWIEVKSVENLDVEKLKEINGVKAVQIEENVIKVNSDAGLNNLNKIVQHFINHDIEIRSLEEQAPNLETVFLTLTGRNLRDK

SEQ ID NO: 215 - DNA, 894 bp, Bacillus cereus
  Bacillus cereus G9241
  CDS (1)..(894): transl_table=11
atgatttcagttcaaaatgtcacaaaacagttttcaaatggaaaaggtttgtttcatataacctttgatgtaaaagaaggagaagtgttcggttacttagggtcgaatggtgcagggaaatccacaacaattcgtaatttaatgggatttataaaaccgacagaaggaaagtcttccattttcggattagattgttgggatgatgctgcgaaaattcaaagagaagtcggttatttaccaggagaaatttcttttattgaaggaatgaacggattagaatttctgaagttaatgcaaggaatgcgcgggctaaaggatacgaagagacgagatgaactaatagaacgtctgcaatttgatgtaaaaacaccgattcgaaaaatgtctaaaggaatgaagcaaaaagtagggattgttgcggcttttatgcatgatccgaaagtgttaattttagatgaaccaacatcaggacttgatccgcttatgcaacaagtgtttatagatttaatagtagaggaaaagcaaagaggaaaaacaattcttatgtcgtcgcatatttttactgaaattgaacgtacgtgtgatcgagtagcgattattaaagatggtcgccttgtaacggttgaaaatattcatgatttacaaagcatgagacgacaggtaatagatgtaaccgtatcatcgcaagaagagattgaatctcttacgcaatgtaatttgcaatttgaagcggtgaaaggtagagaagcatcgattatcgtacaaggaaactatcaaactgttttacaaatactttcaaactataatgtaacagcacttcaaacgagagcgatggatttagaacatttatttatgcattattacgataagaaagaaggggtaaagcatgaataa

SEQ ID NO: 216 - protein, 297 aa, Bacillus cereus
  Bacillus cereus G9241
MISVQNVTKQFSNGKGLFHITFDVKEGEVFGYLGSNGAGKSTTIRNLMGFIKPTEGKSSIFGLDCWDDAAKIQREVGYLPGEISFIEGMNGLEFLKLMQGMRGLKDTKRRDELIERLQFDVKTPIRKMSKGMKQKVGIVAAFMHDPKVLILDEPTSGLDPLMQQVFIDLIVEEKQRGKTILMSSHIFTEIERTCDRVAIIKDGRLVTVENIHDLQSMRRQVIDVTVSSQEEIESLTQCNLQFEAVKGREASIIVQGNYQTVLQILSNYNVTALQTRAMDLEHLFMHYYDKKEGVKHE

SEQ ID NO: 217 - DNA, 927 bp, Lactobacillus casei
  Lactobacillus casei ATCC 334
  CDS (1)..(927)
ttgaacatcctaactttgcaacatgtcagcaagcattttggtagcaagcaagtgctgcaagatctgaatctgactgtgccggctgggtcgatttatggctttgttggcgaaaatggtgccgggaaaaccacgactatgaaattgattctaggcttggatcaagccagcgccggagccattgaagtcgctggtcagcctgtgcatttcggtgaaacggagacgaatcggcagacagggtatctgcctgatgtgccggctttttatgggtacatgacggcaccagaatacttgaaattatgcggtcagctgacaggtttgcgcggcgctgaattgcagtcgcgggtggctgccatgttgatccaagtcggcttggcagatgccaagcaccgtatcagtggcttttcgcgggggatgcgccaacgcttggggattgcgcaggccttactcaacaccccgaaactcttgatttgtgatgaaccgaccagcgcgcttgatccacagggtcgcacggattttttacagttattggctagtctgcgtggtcagactacgattctgttttcaacgcatattctgagtgatgtggagcggatttgcgaccatgtcgggattctacatcatggccgtctacaagtgagtgcgccattggacgatctgaagcaacagtatgctaaaaaccagattgccttgtcgtttgcgacaactgcccaagcgcaacaagccgcgcatttgttggcaaccttgcagcagggccagctgacgcaccttgagcaacaaaaaaacagtcttcaagcagcatacaccggtacctatgctgccgctgctgatcgcgtcctcaccatgttgcttgaagccaaactcattccgatcacgcttgcccagcgagaagccaatttggaacagatcttcatggaggtgacgcgatga

SEQ ID NO: 218 - protein, 308 aa, Lactobacillus casei
  Lactobacillus casei ATCC 334
MNILTLQHVSKHFGSKQVLQDLNLTVPAGSIYGFVGENGAGKTTTMKLILGLDQASAGAIEVAGQPVHFGETETNRQTGYLPDVPAFYGYMTAPEYLKLCGQLTGLRGAELQSRVAAMLIQVGLADAKHRISGFSRGMRQRLGIAQALLNTPKLLICDEPTSALDPQGRTDFLQLLASLRGQTTILFSTHILSDVERICDHVGILHHGRLQVSAPLDDLKQQYAKNQIALSFATTAQAQQAAHLLATLQQGQLTHLEQQKNSLQAAYTGTYAAAADRVLTMLLEAKLIPITLAQREANLEQIFMEVTR

SEQ ID NO: 219 - DNA, 1389 bp, Anaeromyxobacter dehalogenans
  Anaeromyxobacter dehalogenans 2CP-C
  CDS (1)..(1389): transl_table=11
atgaacgggctggagagcccgccggtggcggcggtgaggatcatctgcccgaccaccgcggccacgaggttgatccgcacctggccgggcgcgagcccgccgcggcgccggaagcggacgtactcgacggtgaagaacgcggcgatcgtcaccaggatcgcggcgagcagcgcccgccgccacggcgtcggatccacccacgccatccaggcgccggcggccagcaccagcgggaccagcagcaggcgcgcgccgacgagctgcccgaacagccgggacagctcctcgcgctggatctggtcgtgtccgggcggtggcatctgctcgatccgggggggggcggggcggctcgccgcgaccaccatacgacgggcggcgttcctgcgcacgggcggcgcacggacgcgcatgcaggaagtcgagcggacgcccgcggggcacgctagattcgcgcgacccatggaacccgtcgtggagatccgcggggtccgcaagcagttcggcgggctgaccgcgctggagcgcgtggacctcgagatccgcgccggcgagatcttcgccctgctgggcccgaacggcgccggcaagaccacgctcatctcgatcatcgccgggctgctccgggccaccgagggcgaggtgcgggtgctgggcaaggacgtggtgcgggactaccgccacacgcgccgcgccatcggcctcgtcccccaggagatcaacttcgacccgttcttcacggtcgaggagacgctccgcatccaggccggctacttcggcgtggcgctcgccgaggagcggctggtggagatcctccgcgcgctcgacctgctcgggaagcgcaccgtgaacagccgcgcgctctccggcggaatgaagcggcgcctcctcatcggcaaggcgctggtgcacgacccgaaggtcctgttcctcgacgagcccaccgccggcgtggacgtcgagctgcgccgctcgctctgggagtacgtgcgcacgctgcgcgcccgcgggaccacggtggtcctcaccacgcactacctcgaggaggccgaggagctggccgaccgggtgggcgtgatcgaccgcggccggctgctggcgctggagggcaaggacgagctgctccgccggcacggcgcgaagacgctccggctggtgctggacgtgccgcgggcggtggtcccgccgtcgctggcggcgctgggcggcaagctggaggagggcggcgcggcggtggcggtggaggtgccggccggcgagggcttcggcccggtgctgcgcgcggcggcggcggcggggctgggggtgaaggacgtggagacccggcgcaccacgctcgaggacgtgttcgtccggctgctggcgggcgggcaggcgcgggggggccgatga

SEQ ID NO: 220 - protein, 462 aa, Anaeromyxobacter dehalogenans
  Anaeromyxobacter dehalogenans 2CP-C
MNGLESPPVAAVRIICPTTAATRLIRTWPGASPPRRRKRTYSTVKNAAIVTRIAASSARRHGVGSTHAIQAPAASTSGTSSRRAPTSCPNSRDSSSRWIWSCPGGGICSIRGGAGRLAATTIRRAAFLRTGGARTRMQEVERTPAGHARFARPMEPVVEIRGVRKQFGGLTALERVDLEIRAGEIFALLGPNGAGKTTLISIIAGLLRATEGEVRVLGKDVVRDYRHTRRAIGLVPQEINFDPFFTVEETLRIQAGYFGVALAEERLVEILRALDLLGKRTVNSRALSGGMKRRLLIGKALVHDPKVLFLDEPTAGVDVELRRSLWEYVRTLRARGTTVVLTTHYLEEAEELADRVGVIDRGRLLALEGKDELLRRHGAKTLRLVLDVPRAVVPPSLAALGGKLEEGGAAVAVEVPAGEGFGPVLRAAAAAGLGVKDVETRRTTLEDVFVRLLAGGQARGGR

SEQ ID NO: 221 - DNA, 1371 bp, Arthrobacter
  Arthrobacter sp. FB24
  CDS (1)..(1371): transl_table=11
gtgtgcaccttccgctgccccgggctccccgccgggccatacgcccggcgcagtgcgtcgacgtgcccggcaaggaataccgccaacatcgcggcgacgcccccggcggcagctttgcgtgtggccgggatcaggagtccgacggcggcacccgcctcgagcagtccgctgagcgccacccattcatcacgggtcatcacggcgcacgggccgtttggccgggctccggagtcatcccggcacaggaagtcgggcaccacctggtggaagaaggcggggtcacggaagtgcttcatggcgctcgtcagcagcagggcgctcatggcagccgctgagagtgtctgggtggcccgggcggaccaggtgaatggcatggatccatgcaaccacagccgcggacaccccggtaaacgggactttccgcccgtgtcaggagccacagcgcggcgtagcttgttgactatgagcagcgtggtggaaatgaccggcgtcgtaaagcgcttcggaacggtaactgccctcgacgggctcgacttcaacgtggcggcgggcgaggttcacggcttcctgggtcccaacgggtccggcaagtccaccacgctgcggcttctgctgggcatgctgcgtgccaactcgggctcgatccgggtgctgggcatggatccctggcacgatgttgccgcgctgcaccgccggctggcgtacgtgcctggcgacgttgcgttgtggccgaacctgaccggcggcgaggtgatcgacctgctggggcggctccagggcggacaggaccgcgcccggcgggaccggctgctgcggacgttcgacctcgaccccaccaagaagtcgcgcacgtattccaagggcaaccggcaaaaagttgccctggtggccgccttggccaccgacgccgagctcttcctcctggatgagcccaccagcgggctggacccgttgatggaggacgccttccgcgggtgcgtgcgggagctgcggtcgcagggccgcacggtcctgctgagcagccacatactgagcgaggccgaggcgctctcggacagggtcagcatcatccgcgccggccgggtggtggagtccgggccgctggagcagctgcggcacctgacccggacgtcggtcacggccgacgtcgcgcgcgtgcccgcgggcctggatctcctgcccggcgtccacgacgtcgtggtgtcggaccaccgtgtgagcgcccaggtggaccccgtggcgctgggcccgtttctgcaggccctgacggccgccggactgcacgccctgaccagccagccgcccacgctggaggatctgttcctgcgccactacggcccggccggatcgctcgaatcggcacggcgatga

SEQ ID NO: 222 - protein, 456 aa, Arthrobacter sp.
  Arthrobacter sp. FB24
MCTFRCPGLPAGPYARRSASTCPARNTANIAATPPAAALRVAGIRSPTAAPASSSPLSATHSSRVITAHGPFGRAPESSRHRKSGTTWWKKAGSRKCFMALVSSRALMAAAESVWVARADQVNGMDPCNHSRGHPGKRDFPPVSGATARRSLLTMSSVVEMTGVVKRFGTVTALDGLDFNVAAGEVHGFLGPNGSGKSTTLRLLLGMLRANSGSIRVLGMDPWHDVAALHRRLAYVPGDVALWPNLTGGEVIDLLGRLQGGQDRARRDRLLRTFDLDPTKKSRTYSKGNRQKVALVAALATDAELFLLDEPTSGLDPLMEDAFRGCVRELRSQGRTVLLSSHILSEAEALSDRVSIIRAGRVVESGPLEQLRHLTRTSVTADVARVPAGLDLLPGVHDVVVSDHRVSAQVDPVALGPFLQALTAAGLHALTSQPPTLEDLFLRHYGPAGSLESARR

SEQ ID NO: 223 - DNA, 987 bp, Crocosphaera watsonii
  Crocosphaera watsonii WH 8501
  CDS (1)..(987): transl_table=11
atgtctgtaatcaacgtcaaaaatcttagtaaaacttataaagtttctttaaaaaagccaggtttcaaaggcacgattgaccacttttttaaacgcacgtatagagatatagtagcagtgaaagatgtatcatttaccattaattctggtgagattgttggctttttaggggcaaatggtgcaggaaaaaccaccactctaaaaatgttaacaggattaattcacccctcaaatggaaagattaagatagttgatcgtactccttttaagcgtcatcctacttttttaaaaaagatgagtttagttatgggacaaaaacagcaattattatgggatttaccagctttagactccctaaaaattaacgctgctgtttatgaaattcctgacaaaatttttcagcaaagacttcaagaattgtccgaaatgttatccattaaagaacaattaaaccaacctgtacgtaaactatctttgggacaaagaatgaaagcagaattattagctgctttgttacatcatcctcaagttttatttttagatgaacccacattagggttagatgttaattctcaagctgctattcgttccttcttaaaagagtataatgaaagatacgaagcaacgattttattaaccagtcattatatggcggatattactgcattgtgcgaaagagttttattgattcatgagggacaattaatctacgatggaaacttagaggacttagtagaaaagtttacaccctataaagaggttaacgtcgaattatcttatcctttatcatcagaaaaactagcacattatggacaagttgaaacaatgaaaggtcaagaagttagatttttagtcaaacaagaagaccttacagacactatagctaaaattttagctcaattagaggttaacgatctcagtgtaagcgatcctcccattgaagaagttgttagtcaaattttctctaggggaaatgttgatctataa

SEQ ID NO: 224 - protein, 328 aa, Crocosphaera watsonii
  Crocosphaera watsonii WH 8501
MSVINVKNLSKTYKVSLKKPGFKGTIDHFFKRTYRDIVAVKDVSFTINSGEIVGFLGANGAGKTTTLKMLTGLIHPSNGKIKIVDRTPFKRHPTFLKKMSLVMGQKQQLLWDLPALDSLKINAAVYEIPDKIFQQRLQELSEMLSIKEQLNQPVRKLSLGQRMKAELLAALLHHPQVLFLDEPTLGLDVNSQAAIRSFLKEYNERYEATILLTSHYMADITALCERVLLIHEGQLIYDGNLEDLVEKFTPYKEVNVELSYPLSSEKLAHYGQVETMKGQEVRFLVKQEDLTDTIAKILAQLEVNDLSVSDPPIEEVVSQIFSRGNVDL

SEQ ID NO: 225 - DNA, 702 bp, Moorella thermoacetica
  Moorella thermoacetica ATCC 39073
  CDS (1)..(702): transl_table=11
atgattgcatttgaaagggtaactaaaaccttcggctccaccagggccctggatgaattcaccctggagattgccgacggcaagatcaccggtctcttcgggcccaacggcgccggcaaatcgacctgcctgaagatgattgccggcctcaaccgtccgaacgccggccgggtcctcattgacggacgggcaccgggtatgacaactaaaagcatgatagcttatctgccggaaattgattacctgtacccctggatgaccattaatgaagctgccagtttctttgccggtttctatgaagactgggacgagggcaaataccgggacctgttatctttcttgcaactggaaccgtcgatggtgatcagcaaaatttccaagggaatgcgggccaaggtgaaattgctcctgaccttttcccggcgcgccaggtatgttctcctggatgaacccctctcgggcatcgatattttgacccgtgatgcaatcatccgcaccatcgtcaaggactacagtgccggcgagcagaccatcatcctttccacccacgagatcccggaggttgaagggctggtggaggatgtggttttcatagaccgggggcgagttaagctggccggtacggccgaaaatttgcgccagcgggaaggccggtccctggtggccattatgaaggaggttttccgccatgacaacgactaa

SEQ ID NO: 226 - protein, 233 aa, Moorella thermoacetica
  Moorella thermoacetica ATCC 39073
MIAFERVTKTFGSTRALDEFTLEIADGKITGLFGPNGAGKSTCLKMIAGLNRPNAGRVLIDGRAPGMTTKSMIAYLPEIDYLYPWMTINEAASFFAGFYEDWDEGKYRDLLSFLQLEPSMVISKISKGMRAKVKLLLTFSRRARYVLLDEPLSGIDILTRDAIIRTIVKDYSAGEQTIILSTHEIPEVEGLVEDVVFIDRGRVKLAGTAENLRQREGRSLVAIMKEVFRHDND

SEQ ID NO: 227 - DNA, 948 bp, Sphingopyxis alaskensis
  Sphingopyxis alaskensis RB2256
  CDS (1)..(948): transl_table=11
atgacagccgttctccagctctccggcctcggaaaaacctataaaagcggtcacatagcactcagcaatgtcgatctcgaaatcaacaagggcgaaattttcgcgctgctcggccccaatggcgcgggcaagacgacgctgatcagcatcgtgtgtggaatcgtcacggccagctcgggaactgtgctggtcggggggcatgaccatgcccgcgattatcgcgccgcgcggtcgatgatcgggctggtgccgcaggaactgcacaccgacgcctttgaaaccgtgctcgcgacggtcagcttttcgcgcgggctgttcggcaagcccaaaaaccccgcctatatcgaacaattgctccgcgacctgtcgctgtgggacaagcggaacagcaagatcatggaactgtcgggcggcatgaagcgccgcgtgatgatcgccaaggcgctgagtcacgaacccgaaatcctgttcctcgacgaaccgaccgcgggggtcgatgtcgagctgcgccgcgacatgtgggcgatggtgcatgggcttcgcgagcgcggcgtgacgatcatcctgacgacgcattatatcgaggaggccgaagaaatggccgaccgcgtcggcgtcatcagcaagggacagatcatcctcgtcgaggaaaaacatgcgctgatcaagaaactcggccgcaagacgctgacgctcaatcttgccgagccgctggacgccgtgccgcccgaactggcggactggaagctcgaactggcgggcgacgggcacgaacttgtctacgagttcgacagtcaggccgaagcgacgggcgtaccctcgctgctccgccggatgtccgacatcggcgtcggtttcaaggacctgcatacaaagcaaagctcgctcgaggatattttcgtcgggctggtgcgagaggataagggcgcgagggaggcgaccgcatga

SEQ ID NO: 228 - protein, 315 aa, Sphingopyxis alaskensis
  Sphingopyxis alaskensis RB2256
MTAVLQLSGLGKTYKSGHIALSNVDLEINKGEIFALLGPNGAGKTTLISIVCGIVTASSGTVLVGGHDHARDYRAARSMIGLVPQELHTDAFETVLATVSFSRGLFGKPKNPAYIEQLLRDLSLWDKRNSKIMELSGGMKRRVMIAKALSHEPEILFLDEPTAGVDVELRRDMWAMVHGLRERGVTIILTTHYIEEAEEMADRVGVISKGQIILVEEKHALIKKLGRKTLTLNLAEPLDAVPPELADWKLELAGDGHELVYEFDSQAEATGVPSLLRRMSDIGVGFKDLHTKQSSLEDIFVGLVREDKGAREATA

SEQ ID NO: 229 - DNA, 984 bp, Ferroplasma acidarmanus
  Ferroplasma acidarmanus Fer1
  CDS (1)..(984): transl_table=11
atggattatagcatagaaatagacaaattgacaaagatatttaacggaaaagttactgctgtcgataacgtcagcttgaaaataggatcagggcagatatacggcctgctcgggcaaaacggggcaggaaaatcaacattaattaaaatgcttacaggcagcctgactccaacatccggtacagctaaaattgccggattagatttaacaaaggactcaatgaaaataagaaagattaccggtgtggtgccacaggatcttacaacggatggagacctaagcgggagggagaaccttaaattgattgcagatttatacggcataccgaaaaaagaggcccttgaaagaatagatgttcttctccatatggttgatttatatgatgttcgggacaggcatgctgagaattattctggcggcatgagaaaaaggctcgaacttgcatgtggattaatgaatacaccagaggtattatttctggacgaacccacactggggctggatgttaccacaagggaaaacctctggaaatatatccggtcggtacagaaagaattccatataaccataatattgacatcccattatctggatgaggtggacgcacttgcaaatgaattatccataatagaccatggaaaaataataatttcgggtacatcagatgagttaaagaagagccttaagggtgatattataacattaaaagtaaaaaatgatgatgaatacagcaaactggaaaaattcccggaatcacttgaaataaaacgtatggaaacgggagatgtgaggatgaaggtaaacaattcagatgaagtgctgccaaagcttatgaagttcctgggggaaaatgaaatttctccagaagctataagcatacgcaaaccgtcacttgatgaggtatttatcgagtataccggaagaaatataaattctgaagcgggaaacaccgattatgcaaaattaatgatggggaggagataa

SEQ ID NO: 230 - protein, 327 aa, Ferroplasma acidarmanus
  Ferroplasma acidarmanus Fer1
MDYSIEIDKLTKIFNGKVTAVDNVSLKIGSGQIYGLLGQNGAGKSTLIKMLTGSLTPTSGTAKIAGLDLTKDSMKIRKITGVVPQDLTTDGDLSGRENLKLIADLYGIPKKEALERIDVLLHMVDLYDVRDRHAENYSGGMRKRLELACGLMNTPEVLFLDEPTLGLDVTTRENLWKYIRSVQKEFHITIILTSHYLDEVDALANELSIIDHGKIIISGTSDELKKSLKGDIITLKVKNDDEYSKLEKFPESLEIKRMETGDVRMKVNNSDEVLPKLMKFLGENEISPEAISIRKPSLDEVFIEYTGRNINSEAGNTDYAKLMMGRR

SEQ ID NO: 231 - DNA, 867 bp, Paracoccus denitrificans
  Paracoccus denitrificans PD1222
  CDS (1)..(867): transl_table=11
atgccggcaccgcgacgatcagcttcatcgccatcgttccgggccgctatacgctgtcgatccccggctcgcagggtgaaacccagcaggcggtgttcaacatccagtaacaaagggggcggggtctttggctccgcccttcgccagatgccgcaggacgcgctttccatccagcatgtcagccacagcttcggccgcgtccccgcgctgaaggacgtgtcgctgaccgtgccgcgcggcggcttcaccgcgcttctgggcgtgaacggcgctggcaagaccacgctgttctcactgatcaccaggctttacgacaaccgctcgggccggatcgaggtggcggggcatgacctgcgccgccagcccggcgcggcgctggcgcggctgggggtggtgttccagtcccgtgcgctggatgccgacctgaccgtggcgcagaacctggaatatcatgccgcgctgcatggcattccccggcgcgaggcgcgggcgcgcagtgtcgaggtgctggcgcaggtcgatctgtcggaccggctgcatgccagggtctcggcgctgtcgggcgggcagagccgccgggccgagatcgcccgcgccctgatccaccgtcccgagatcctgcttctggacgaggcgaccgtcggccttgacgtgaaatcccgcgccgaggtggtggcgctgacccgcgaactggtgcggggcggggtctctgcactgtgggccacgcatatcctcgacgagatccggcccgaggacgggctggtcatcctgcacaagggcgaggtgctggcgcgcggcaatgccggagagatcggcggcgacgacctgaccgccaccttcctgcgcctgaccggggagccggcatga

SEQ ID NO: 232 - protein, 288 aa, Paracoccus denitrificans
  Paracoccus denitrificans PD1222
MPAPRRSASSPSFRAAIRCRSPARRVKPSRRCSTSSNKGGGVFGSALRQMPQDALSIQHVSHSFGRVPALKDVSLTVPRGGFTALLGVNGAGKTTLFSLITRLYDNRSGRIEVAGHDLRRQPGAALARLGVVFQSRALDADLTVAQNLEYHAALHGIPRREARARSVEVLAQVDLSDRLHARVSALSGGQSRRAEIARALIHRPEILLLDEATVGLDVKSRAEVVALTRELVRGGVSALWATHILDEIRPEDGLVILHKGEVLARGNAGEIGGDDLTATFLRLTGEPA

SEQ ID NO: 233 - DNA, 2181 bp, Mycobacterium leprae
  CDS (1)..(2181): transl_table=11
atgcagatggatctatgcatccatcgtcgtatggctttgctatgccaggccactaggcgatgccatcgctggaaaacccaactgggtcggtgcgctgcgccggacttagccccagggactggcacaattggtaaagtgaccgcgcacgatccacgccatttgcatcatcggagcggatcgctgcaaccgggtgaattggcacaagcttcggtcttggcagccctgtgcgcggtcaccgcgatcgtctcggtcgtggtccccttcgcggccggactagccttgcttggtaccgtgcccatgggcttgctcgcctaccgctaccgcttccgtgtgctgatgaccgcgatggttgcggccggggtaattgcctttctgatcaccgggttgggcggtttcatagctgttgtcaacagcgcttatatcggcgggttgaccggagtcgtcaagcgtaaaggccagggcacactaacggtgattgcgcttgccctgttcgccggattggctttcggcgccgccaacgttgttgcgctggtcgtgctcggccggctgcggcacttgatctttaaagcgatgactgcaaacgtggatggcattgcggccaccctgacttggatgcatctgccgtgggtcgcggtccagctaaagcggtatttcgctgacgggttgcagcactggccgtggatgctgctcggctattttgtcatcaccattctggtcgtgtcgttgatcggttggtgggtcttatcgcgcgtgctggagcggattcgtgacatccccgacgtccataaactggacgccccaagcgcttgcaacgaggatgctcctgtcgggccagttccggtgtggctagacaaggtgcgcttccgttaccctcacgccggtcaagacgcgttgcgtgaggtcagtttggacctgcgggtcggtgaacatgtggcggtcactggtgccaacggttccgggaagaccacgctgatgctgatccttgccggcagggaaccgacgtcgggcacagtggatcgtccgggcgcggtgggtttgggcaagctcggtggcactgccgttgttctgcaacaccccgaaagccaggttctgggcacccgggtcgccgacgatgtggtgtgggggttgccgccgggaaccgatgtcgacgtcaaccggttacttcgggaggtcggcctcgacgcattcgccgaacgcgacaccggtagcctctccggcggtgaactgcagcgcctcgcactggcagcggccttagcccgagagccatcgctgttgatcgccgacgaagtcaccagcatggttgaccgacagggccgggatgccttgctgggtgtgctatccggtctcaccaaacgacaccccatcgccttggtacacatcacacactacaacaacgaagccgataccgctgatcgaacgatcaacctcagtgattcacccgacaacgccggcatggctgagaccgttgcgccaccggtgtcgaccgttgcggtggatcaccgcccgcacgcaccggtactcgaacttgtaggtgttggccacgaatacggcagcggtactccatgggccaaggccgcgctacacgatatcagcttcgtggtcaggcagggagatggggtactggtgtatgggagtaacggctcgggcaagtcgacgctggcgtggatcatggccggattgatggttcccacgaccggtgcatgcctgatcgatggtcggcccactcacgagcacgtcggcgccgtagcattgtctttccaggctgccaggttgcagcttatgcgcagtcgcgttgatttggaagtggcttcggcggcaggcttttcgccccgtgacgaagaccgcgtggctgccgcactgggcgttgtcgggctagatcccgcgctggccaaacggcgcatcgaccagctcagcggcggccagatgcgccgggttgtgctggccggtctgttagcgtgttcgccgcgcgcgttgatacttgacgagccactggcggggttggatgcggtcagccagcgtggcctgctgcggttgctggaggacctgcgctgtgagcggggtctgacggtggtcgttacttcccatgacttcgtcgggttggaggacgtgtgtccgcgcaccgtacatttgcgtaatggtgcgttggaatcggtgtcgaccaccgctggtggtacgtcgtga

SEQ ID NO: 234 - protein, 726 aa, Mycobacterium leprae
MQMDLCIHRRMALLCQATRRCHRWKTQLGRCAAPDLAPGTGTIGKVTAHDPRHLHHRSGSLQPGELAQASVLAALCAVTAIVSVVVPFAAGLALLGTVPMGLLAYRYRFRVLMTAMVAAGVIAFLITGLGGFIAVVNSAYIGGLTGVVKRKGQGTLTVIALALFAGLAFGAANVVALVVLGRLRHLIFKAMTANVDGIAATLTWMHLPWVAVQLKRYFADGLQHWPWMLLGYFVITILVVSLIGWWVLSRVLERIRDIPDVHKLDAPSACNEDAPVGPVPVWLDKVRFRYPHAGQDALREVSLDLRVGEHVAVTGANGSGKTTLMLILAGREPTSGTVDRPGAVGLGKLGGTAVVLQHPESQVLGTRVADDVVWGLPPGTDVDVNRLLREVGLDAFAERDTGSLSGGELQRLALAAALAREPSLLIADEVTSMVDRQGRDALLGVLSGLTKRHPIALVHITHYNNEADTADRTINLSDSPDNAGMAETVAPPVSTVAVDHRPHAPVLELVGVGHEYGSGTPWAKAALHDISFVVRQGDGVLVYGSNGSGKSTLAWIMAGLMVPTTGACLIDGRPTHEHVGAVALSFQAARLQLMRSRVDLEVASAAGFSPRDEDRVAAALGVVGLDPALAKRRIDQLSGGQMRRVVLAGLLACSPRALILDEPLAGLDAVSQRGLLRLLEDLRCERGLTVVVTSHDFVGLEDVCPRTVHLRNGALESVSTTAGGTS

SEQ ID NO: 235 - DNA, 750 bp, Methylobacterium extorquens
  CDS (1)..(750): transl_table=11
atgagcgcggctcttgaggtcgccggcgtcagccaccgcttcggccagcgcgccgcgctgtccgacgtgtcgatcaccgtcgagcgcgggcacttcatggcgctgctcgggcccaacggcgcgggcaagactacgttgttctcggtgattacccggctctacaacaatcaggagggccgggtctcgatcctcggccatcccctcgaccgtgagccgtcgcgggcgctcgccggcctcggcgtggtgttccaggcgcggacgctggataccgacctcaccgtcgcgcaaaacctgcattaccacgccagcctgcacggcatcggccgggcggcggcgcgtgcgcgcatcgagaccctgctcgcccgcgtcggcctcgccgagcggcgcgacgacaagatccgcaccctttccgggggccagtcgcggcgcatcgagatcgcccgctcgctgatccacgcgccgcgcctgctgctgctcgacgagccgaccgtcgggctcgatctcgaatcgcgcgccgacatcgtcgccatcgtccgcgccctggtgcgggaggaggggctctcggtgctgtgggcgacccacatcttcgaggagatttcgcccgaggacgacgccgtggtcctgcacaagggtcgcatcgtcgcccgtggccgcgccggggagatcggtgggcccggcgagacgctggaagccgccttccgccgcctcgtcgccgaacccgacaagagagccgtgaagtccgccgcatga

SEQ ID NO: 236 - protein, 249 aa, Methylobacterium extorquens
MSAALEVAGVSHRFGQRAALSDVSITVERGHFMALLGPNGAGKTTLFSVITRLYNNQEGRVSILGHPLDREPSRALAGLGVVFQARTLDTDLTVAQNLHYHASLHGIGRAAARARIETLLARVGLAERRDDKIRTLSGGQSRRIEIARSLIHAPRLLLLDEPTVGLDLESRADIVAIVRALVREEGLSVLWATHIFEEISPEDDAVVLHKGRIVARGRAGEIGGPGETLEAAFRRLVAEPDKRAVKSAA

SEQ ID NO: 237 - DNA, 927 bp, Pseudomonas sp
  CDS (1)..(927): transl_table=11
atgagcgctgtaaagatccagggcgtgaaccagcgttacggcagcatgaccgtgctgcatgatctgaacctgaccctcggcgagggcgaggtgctgggcctgttcggccacaacggtgccggcaagaccaccagcatgaaactgattcttggcctgctcacgcccagcgaagggcaggtgcgtgtgctcggtcgggcgccgcatgatcccgaagtccgccgccagctgggttacctgcccgagaacgtgaccttctatccgcagctcagtggccgcgagacgctgcggcacttcgctcggctgaaaggcgcagcagtgaagcaggtggacgaattgctggaacaggtcgggctgtcccacgctgccgagcgtcgggtgaagacctattccaagggcatgcgccagcgtctcggcctggctcaggcgctgcttggtgagccgcgtctgctattgctcgacgaacccacggtggggctcgatcccatcgcaaccggcgatctctatgagctgatcgaccggatgcgccaacgcggcaccagcgtcattctctgctcgcatgtgctgcccggcgtcgaagcgcatatcaatcgggcggcgattctggccaaaggtcagctacaggcggtcggcagcctggcgcagctgcgcgtcgaggcggggctgccggtgcgcattcgcgccagtggcatcggcgacagcgccggctggttgcagcgttggggagacgcgggccatagcgcacgttcgctgggagaacacagcgtcgaggtgtcggccatcaatggccacaaactgccgctgctgcgcgaattgctgggcgagggcgagccggatgacatcgaaatccatcaaccatcgctcgaagacctgtatcgctactacatgcagcgcgccggcgacgtccgcgcggcggagggcacgttatga

SEQ ID NO: 238 - protein, 308 aa, Pseudomonas sp
MSAVKIQGVNQRYGSMTVLHDLNLTLGEGEVLGLFGHNGAGKTTSMKLILGLLTPSEGQVRVLGRAPHDPEVRRQLGYLPENVTFYPQLSGRETLRHFARLKGAAVKQVDELLEQVGLSHAAERRVKTYSKGMRQRLGLAQALLGEPRLLLLDEPTVGLDPIATGDLYELIDRMRQRGTSVILCSHVLPGVEAHINRAAILAKGQLQAVGSLAQLRVEAGLPVRIRASGIGDSAGWLQRWGDAGHSARSLGEHSVEVSAINGHKLPLLRELLGEGEPDDIEIHQPSLEDLYRYYMQRAGDVRAAEGTL

SEQ ID NO: 239 - DNA, 849 bp, Arabidopsis thaliana
  CDS (1)..(846)
  MISC_FEATURE (790)..(792): codon "aas" code for Asn or Lys
atggcggagaaaaatgcgagcgcggtggacggtgcaattagggttagtggaatgcagttttcttacgatgttcaagatcctattttcttcgattttaatctcgatcttcccgctggatctcgttgcctcttggttggtgccaatggatctgggaaaaccacattattgaagattttggctggaaagcatatggttggaggaaagaatgttgtacaagtgctggatcgctcagcatttcatgatacagagcttgtttgtagtggtgatttgtcttaccttggaggatcatggagtaaaactgctggttctgctggtgatattccacttcaaggagacttctcagcagaacatatgatatttggagttgaagggattgatcctttcagaagagagaaattgattgatcttcttgatatcaatcttcaatggcgtatgcataaggtttctgatggacagagacgtcgagtgcaaatatgtatgggtcttttacatccattcaaggtgttactactggatgaggttactgttgacctcgacgttgttgctaggatggatttgttggagttctttaaagaagaatgtgaacagagaggagctacaattgtatatgcaactcatattttcgacgggctcgagacatgggctagtcatctggcttatattaatggaggagagctgaaactctcggccaaattagatgagatcaaggatctcaagacctcaccaaatctgctctctgttgttgaagcttggctccggtctgaaaccaaagttgagaaaaagacgaagaasaaacctgttgttacctctccatttatgtcgtctagacaaatggcatattaccgatga

SEQ ID NO: 240 - protein, 282 aa, Arabidopsis thaliana
  MISC_FEATURE (264)..(264): Xaa is Asn or Lys
MAEKNASAVDGAIRVSGMQFSYDVQDPIFFDFNLDLPAGSRCLLVGANGSGKTTLLKILAGKHMVGGKNVVQVLDRSAFHDTELVCSGDLSYLGGSWSKTAGSAGDIPLQGDFSAEHMIFGVEGIDPFRREKLIDLLDINLQWRMHKVSDGQRRRVQICMGLLHPFKVLLLDEVTVDLDVVARMDLLEFFKEECEQRGATIVYATHIFDGLETWASHLAYINGGELKLSAKLDEIKDLKTSPNLLSVVEAWLRSETKVEKKTKXKPVVTSPFMSSRQMAYYR

SEQ ID NO: 241 - DNA, 894 bp, Bacillus thuringiensis
  Bacillus thuringiensis serovar thuringiensis
  CDS (1)..(894): transl_table=11
atgatttcagttcaagatgtcacaaaacagttttcgaatggaaaaggtttgtttcatattacatttgatgtaaaagagggagaagtatttggttatttaggaccgaatggtgccggaaaatcaacgacgattcgtaatttaatgggatttataaaaccgacagctggtaaagctacaatttttggattagattgttggaatgaagcagcgaaaattcaaagggaagttggttatttaccgggtgaaatttcttttattgaaggaatgaacggattagagtttttaaaattaatgcagggaatgcgtggattaaaggatacgaaaagacgagatgaactgatagagcgtctgcaatttgatgtgaaaacaccgattcgcaaaatgtctaaaggaatgaagcaaaaagtagggatagtcgctgcatttatgcacgatccagaggtgttaattttagatgaaccaacatctggacttgatccacttatgcaacaagtgtttatagatttaatattagaggaaaagcaaagaggaaaaacaatcctaatgtcatcacatatttttactgaaattgagagaacttgtgacagagtagctattattaaagatggtcgactcgtaacggttgaaaatattcacgatttacaaagtatgagaagacaggtgatagatgtaacagtatcatcacaagaagagattgagtcccttataaagtgtaatttgcaatttgaagcggtaaaaggtagagaggcatctatcattgtacaaggaaactatcaaactgttttacaaacactttcaaactataatgtaacggcacttcaaacgagagcgatggatttagaacatttatttatgcattattacgataagaaagaaggggtagcgcatgaataa

SEQ ID NO: 242 - protein, 297 aa, Bacillus thuringiensis
  Bacillus thuringiensis serovar thuringiensis
MISVQDVTKQFSNGKGLFHITFDVKEGEVFGYLGPNGAGKSTTIRNLMGFIKPTAGKATIFGLDCWNEAAKIQREVGYLPGEISFIEGMNGLEFLKLMQGMRGLKDTKRRDELIERLQFDVKTPIRKMSKGMKQKVGIVAAFMHDPEVLILDEPTSGLDPLMQQVFIDLILEEKQRGKTILMSSHIFTEIERTCDRVAIIKDGRLVTVENIHDLQSMRRQVIDVTVSSQEEIESLIKCNLQFEAVKGREASIIVQGNYQTVLQTLSNYNVTALQTRAMDLEHLFMHYYDKKEGVAHE

SEQ ID NO: 243 - DNA, 990 bp, Thermoplasma volcanium
  CDS (1)..(990): transl_table=11
atgccgataataaaaactgagaacctaactaaaatttattcggggaacataaaggccgtatcggatctaaacatagagattgaagaagccgagatatacggtctgctaggcaaaaatggggcaggcaaaacgactacaataaaaatgttgactacagctatagaacccacctccggcaatgcaaaagttgctggttacgaccttttgaaagatcgcgaaaaaataaggaatataatcggtgtagtcccgcaggacttgaccaccgacgctgatctaaagggaatagaaaatctaagaatgatagcggcgttctacgatataccaaagtctgtagctgaatcaaggataaacgatctcctcaacatagttgatttgactgattggggaaataagtatgtatcgcagtactcaggcggaatgagaaagaggcttgagctaatatgcggcctggtaaatgccccaaagatcctgttcctagatgagccaacgcttggtctcgatgtaaataccagggcgaagatgtggaaatatataagggacatacaaaaggagcttggagtaacgataatattgacgtcgcactaccttgaggaggttgacgagctcgcaaacaggatctcaataattgatcacggcaagatactcgttactggtacgccggatgaactaaaatcaagcctcaagggagacattataactatgcagttttcaggatcagatgaagccgaggcggcccgctattatccaaacgccttatattcttctatttctggagaagacaaggtgagaataaaagttgaaaactctgacgtagagctaccaaaaatactctcttatctaacgcagaaaggcatatccccgttgacaataaacgttaagaagccctcgcttgacgaagtatttcttgagtacactgggagctcaattgatgaggatataggcccggaacagttcagaaggatgatgcagaacgtaaggaggttgaggtag

SEQ ID NO: 244 - protein, 329 aa, Thermoplasma volcanium
MPIIKTENLTKIYSGNIKAVSDLNIEIEEAEIYGLLGKNGAGKTTTIKMLTTAIEPTSGNAKVAGYDLLKDREKIRNIIGVVPQDLTTDADLKGIENLRMIAAFYDIPKSVAESRINDLLNIVDLTDWGNKYVSQYSGGMRKRLELICGLVNAPKILFLDEPTLGLDVNTRAKMWKYIRDIQKELGVTIILTSHYLEEVDELANRISIIDHGKILVTGTPDELKSSLKGDIITMQFSGSDEAEAARYYPNALYSSISGEDKVRIKVENSDVELPKILSYLTQKGISPLTINVKKPSLDEVFLEYTGSSIDEDIGPEQFRRMMQNVRRLR

SEQ ID NO: 245 - DNA, 1743 bp, Arabidopsis thaliana
  CDS (1)..(1743)
atgtcgttcgaggaagaagaagaggaggaaacattcgagcatacacttctcgtggtgcgtgaggtctccgtttacaagatcccgccgcgaaccacatccggcggatacaagtgcggcgaatggcttcaatccgataagatctggtctggtagactccgcgtcgtatcgtgcaaggatcgatgcgagatccgcctcgaggattcgaattccggtgatcttttcgcagcttgttttgtggatcctggacgtagagagaactctgtagagccgtctctcgattcgtctaggtatttcgttctcaggatcgatgacgggagagggaagtatgcgtttatcgggctaggattcgctgagaggaacgaagcgtttgatttcaatgttgcgttatcggatcatgaaaagtacgttaggagggagaaagagaaggagacaggggaaacgagtgagagcgataatcatattgatatccatcctgccgttaatcacagattgaaggaaaattcttggcatttggacttggtagaacctgaaaagattgttgttttgatgggttttaaggaaggtgaaaccataagaatcaacgtgaagccgaaaccaacaacaaatggcactgggatgctctcagctgctctttcaggaacggggaagccaaaacctctagcacttgccccaccccccaaagctgccggagtaaccaggtctcctttacctcctcctccaaacgatcccgtcgcttcaaggattgcatctgatggctgcaaggaatcacgcaggaacgagcctctatctgatctatctcagctcaaggatcgagcaagtcaacaggagctgcatcaggttgggcagctttctgatgaatggagtagcttttggagactggcaaaaatggcggagaaagatgcgacggcgagtggcgatgacgccattagagttagcggtatgcaattcgcatacgaagttgaggatccaatattcttcgacttcaacctcgatcttccagctggttctcgctgtcttctggttggtgccaatggatctggcaagacaaccttattgaagattctggctggaaagcatatggtgggaggaaagaacgttgtacaagttcttagccgctcggctttccatgatactcaacttgtttgcagtggtgacttgtcttaccttggaggatcatggagtaaaaccgttggttcagctgtgagtaggagaggttcctctccagggagatttctcagcagaacatatgatatttggagaagagaaaaactgattgatcttcttgatatcaatcttcaatggcgtatgcataaggtttctgatgggcagaaacggcgcgtgcagatatgtatgggactcttacatccattcaaggtgttattactcgatgaggtcactgttgacctagacgtcgttgcaaggatggatttgctggaattcttcaaagaagaatgtgatcagagaggagctacaatcgtgtatgcaactcacatattcgacgggctagagacatgggcgacacatttggcctacattcaggacggtgagctgaatcgtttatcgaaaatgacagatattgaggagctgaaaacttcacccaacctcctctccgtggtagaatcttggctccgttctgaaatcaaactcgtgaagaagaagaagaagcctgtggcgccatggaaaccatctccattcgataactctccttttagatcatcgagacacatggcttattaccgatga

SEQ ID NO: 246 - protein, 580 aa, Arabidopsis thaliana
MSFEEEEEEETFEHTLLVVREVSVYKIPPRTTSGGYKCGEWLQSDKIWSGRLRVVSCKDRCEIRLEDSNSGDLFAACFVDPGRRENSVEPSLDSSRYFVLRIDDGRGKYAFIGLGFAERNEAFDFNVALSDHEKYVRREKEKETGETSESDNHIDIHPAVNHRLKENSWHLDLVEPEKIVVLMGFKEGETIRINVKPKPTTNGTGMLSAALSGTGKPKPLALAPPPKAAGVTRSPLPPPPNDPVASRIASDGCKESRRNEPLSDLSQLKDRASQQELHQVGQLSDEWSSFWRLAKMAEKDATASGDDAIRVSGMQFAYEVEDPIFFDFNLDLPAGSRCLLVGANGSGKTTLLKILAGKHMVGGKNVVQVLSRSAFHDTQLVCSGDLSYLGGSWSKTVGSAVSRRGSSPGRFLSRTYDIWRREKLIDLLDINLQWRMHKVSDGQKRRVQICMGLLHPFKVLLLDEVTVDLDVVARMDLLEFFKEECDQRGATIVYATHIFDGLETWATHLAYIQDGELNRLSKMTDIEELKTSPNLLSVVESWLRSEIKLVKKKKKPVAPWKPSPFDNSPFRSSRHMAYYR

SEQ ID NO: 247 - DNA, 840 bp, Streptococcus pneumoniae
  CDS (1)..(840): transl_table=11
atgggaattgctctagaaaatgtgaattttacatatcaagaaggtactcccttagcttcagcagctttgtcggatgtttctttgacgattgaagatggctcttatacagctttaattgggcacacaggtagtggtaaatcaactattttacaactcttaaatggtttattggtgccaagtcaagggagtgtgagggtttttgataccttaatcacctcgacttctaaaaataaagatattcgtcaaattagaaaacaggttggcttggtatttcagtttgctgaaaatcagatttttgaagaaacggttttgaaggacgttgcttttggaccgcaaaattttggagtttctgaagaagatgctgtgaagactgcgcgtgagaaactggctctggttggaattgatgaatcactttttgatcgtagtccgtttgagctgtcagggggacaaatgagacgtgttgccattgcaggcatacttgccatggagccagctatattagtcttagatgagccaacagctggtctagatcctctagggagaaaagagttgatgaccctgttcaaaaaactccaccagtcagggatgaccatcgtcttggtaacgcatttgatggatgatgttgctgaatatgcgaatcaagtctatgtaatggaaaagggacgtttagtaaaggggggcaaaccaagtgatgtctttcaagacgttgtttttatggaagaagttcagttgggagtacctaaaattacggccttttgtaaacgattggctgatagaggcgtgtcatttaaacgattaccgattaagatagaggagttcaaggagtcgctaaatggatag

SEQ ID NO: 248 - protein, 279 aa, Streptococcus pneumoniae
MGIALENVNFTYQEGTPLASAALSDVSLTIEDGSYTALIGHTGSGKSTILQLLNGLLVPSQGSVRVFDTLITSTSKNKDIRQIRKQVGLVFQFAENQIFEETVLKDVAFGPQNFGVSEEDAVKTAREKLALVGIDESLFDRSPFELSGGQMRRVAIAGILAMEPAILVLDEPTAGLDPLGRKELMTLFKKLHQSGMTIVLVTHLMDDVAEYANQVYVMEKGRLVKGGKPSDVFQDVVFMEEVQLGVPKITAFCKRLADRGVSFKRLPIKIEEFKESLNG

SEQ ID NO: 249 - DNA, 927 bp, Pseudomonas stutzeri
  CDS (1)..(927): transl_table=11
atgaacgccgtcgagatccagggcgtaagccagcgttacggcagcatgaccgtgctgcacgatttgaatctgaacctcggtgaaggtgaggtgctggggttgttcggccataacggcgcgggcaagaccaccagcatgaagctgattcttggcctgctctcaccgagcgaaggccaggtcaaggtactcggccgcgcgccgaacgatccgcaagtgcgccgtcagctcggctatctaccggaaaacgtgaccttctatccgcaactgagcggccgcgaaaccctgcgccacttcgctcgcctgaagggcgcggcgttgacccaggtggatgagctgctcgagcaggtcggcctcgcccatgccgcggatcgccgggtgaagacctattccaagggcatgcgccagcgcctcggtctggcccaggcactgctcggcgagccgcgcttgctgctgctcgatgagccgaccgtggggctcgatccgatcgccacccaggatctctatctgctgattgatcgcctgcgtcagcgcggcaccagcatcattctttgctcccacgtgctaccgggcgtcgaggcgcacatcaaccgggctgcaattctcgccaagggctgcctgcaggcagtgggcagcctctcgcaattgcgtgccgaggcagggctgccggtgcgcattcgcgccagtggtatcagcgagcgggacagctggttgcagcgctggaccgatgcaggccacagcgcacgcgggctcagcgagtcgagcatcgaggtcgtggccgtcaacggccacaagctggtgttgctgcgccagctgctgggtgagggagagccggaggacatcgagatccatcagccatcgctggaagacctctaccgctattacatggagcgtgccggcgacgtgcgcgctcaggagggccgtctatga

SEQ ID NO: 250 - protein, 308 aa, Pseudomonas stutzeri
MNAVEIQGVSQRYGSMTVLHDLNLNLGEGEVLGLFGHNGAGKTTSMKLILGLLSPSEGQVKVLGRAPNDPQVRRQLGYLPENVTFYPQLSGRETLRHFARLKGAALTQVDELLEQVGLAHAADRRVKTYSKGMRQRLGLAQALLGEPRLLLLDEPTVGLDPIATQDLYLLIDRLRQRGTSIILCSHVLPGVEAHINRAAILAKGCLQAVGSLSQLRAEAGLPVRIRASGISERDSWLQRWTDAGHSARGLSESSIEVVAVNGHKLVLLRQLLGEGEPEDIEIHQPSLEDLYRYYMERAGDVRAQEGRL

SEQ ID NO: 251 - DNA, 870 bp, Saccharomyces cerevisiae
  CDS (1)..(870)
atggtttcccaatttgctattgaggtgcgtaacctaacgtacaaattcaaagaaagctccgatccgtcagttgttgatatcaatcttcaaatcccatggaatacaagatctttagttgtgggtgccaatggtgctggtaaatccacccttttgaaattactaagcggtaagcatctttgccttgatggaaaaatcctggtcaatggtcttgatccattcagtccattatctatgaatcaagtggacgatgatgaaagtgttgaagattcgacgaactaccaaacgaccacttatctaggtacggaatggtgccatatgagtatcattaatagggatatcggcgtcttggaactattaaaaagtattggattcgatcattttagggaaagaggtgaaagattggttagaatcctggacatcgatgtacgttggagaatgcacaggttaagtgatggacaaaagagaagagttcagttagccatggggctcttgaaaccttggagagttttactacttgatgaggtcactgtggatctcgatgttattgccagagcaagacttctggagtttttaaagtgggagaccgaaaccagaagatgctcagtggtctacgctacacatatttttgacggcttggccaaatggcctaaccaagtataccatatgaaatcaggtaagattgtggataatttagattatcagaaagacgtagagttctctgaagtggtcaatgctaaagttaatggacaagtggcctttgaaaatgacaacaataaggttgttattagtaaagtgaatagtttgcatccattagcactagaatggttgaaacgtgataatcaaattcctgacaaagagattggtatataa

SEQ ID NO: 252 - protein, 289 aa, Saccharomyces cerevisiae
MVSQFAIEVRNLTYKFKESSDPSVVDINLQIPWNTRSLVVGANGAGKSTLLKLLSGKHLCLDGKILVNGLDPFSPLSMNQVDDDESVEDSTNYQTTTYLGTEWCHMSIINRDIGVLELLKSIGFDHFRERGERLVRILDIDVRWRMHRLSDGQKRRVQLAMGLLKPWRVLLLDEVTVDLDVIARARLLEFLKWETETRRCSVVYATHIFDGLAKWPNQVYHMKSGKIVDNLDYQKDVEFSEVVNAKVNGQVAFENDNNKVVISKVNSLHPLALEWLKRDNQIPDKEIGI

SEQ ID NO: 253 - DNA, 16 bp, unknown
  Primer
  misc_feature (5)..(5): n is a, c, g, or t
  misc_feature (10)..(10): n is a, c, g, or t
  misc_feature (13)..(13): n is a, c, g, or t
wgtgnagwancanaga

SEQ ID NO: 254 - DNA, 21 bp, Unknown
  Primer
atggcggtgacggaggaggag

SEQ ID NO: 255 - DNA, 20 bp, Unknown
  Primer
ttatcttagaactctgtttg

SEQ ID NO: 256 - DNA, 31 bp, Unknown
  Primer
atattaattaatggagccgcatatggttagg

SEQ ID NO: 257 - DNA, 28 bp, Unknown
  Primer
atccatggtcagtccgtgtttcaaactc

SEQ ID NO: 258 - DNA, 28 bp, Unknown
  Primer
atccatggtggagccgcatatggttagg

SEQ ID NO: 259 - DNA, 31 bp, Unknown
  Primer
atattaattaatcagtccgtgtttcaaactc

SEQ ID NO: 260 - DNA, 29 bp, Unknown
  Primer
ataggtacctggagccgcatatggttagg

SEQ ID NO: 261 - DNA, 29 bp, Unknown
  Primer
atagtcgactcagtccgtgtttcaaactc

SEQ ID NO: 262 - DNA, 21 bp, Unknown
  Primer
tgacgccatttcgccttttca

SEQ ID NO: 263 - DNA, 27 bp, Unknown
  Primer
cagaaatggataaatagccttgcttcc

SEQ ID NO: 264 - DNA, 23 bp, Unknown
  Primer
ccaatacattacactagcatctg

SEQ ID NO: 265 - protein, 258 aa, Artificial Sequence
  consensus
  MISC_FEATURE (2)..(252): Xaa at positions 2-5, 7-9, 11-15, 38, 41-43, 45-46, 48-52, 55, 63, 65, 68, 70-89, 116-117, 119-151, 169-179, 181, 183, 185, 188, 190-191, 194-198, 205, 207-208, 211-220, 222-228, 234-235, 238-247, 251-252 is any amino acid
  MISC_FEATURE (254)..(257): Xaa at positions 254-255, 257 is any amino acid
  MISC_FEATURE (16)..(249): Xaa at positions 16-36, 39, 90-114, 152-167, 229-230, 248-249 is any or no amino acid
IXXXXLXXXFXXXXXXXXXXXXXXXXXXXXXXXXXXLXXVXXXVXXGXXXXXLGXNGAGKTTXLXILXGXXXXXXXXXXXXXXXXXXXXXXXXXXXXXXXXXXXXXXXXXXXXXIXXLXXXXXXXXXXXXXXXXXXXXXXXXXXXXXXXXXXXXXXXXXXXXXXXXXLXXXXXXXXXXXSXGXRXRVXLXXALXXXXXVLLLDEXTXXLDXXXXXXXXXXLXXXXXXXXXTIIXXTHXXXXXXXXXXXXVXXIXXGXI

SEQ ID NO: 266 - protein, 16 aa, Artificial Sequence
  consensus
  MISC_FEATURE (2)..(14): Xaa in positions 2, 10-14 is any amino acid
  MISC_FEATURE (5)..(5): Xaa is Ala or Ser
  MISC_FEATURE (8)..(8): Xaa is Ser or Thr
  MISC_FEATURE (15)..(15): Xaa is any or no amino acid
GXNGXGKXTXXXXXXG

SEQ ID NO: 267 - protein, 31 aa, Artificial Sequence
  consensus
  MISC_FEATURE (2)..(28): Xaa at positions 2, 4-6, 9, 11-13, 15-20, 27-28 is any amino acid
  MISC_FEATURE (7)..(7): Xaa is Lys or Arg
  MISC_FEATURE (8)..(8): Xaa is Ala, Ile, Leu or Val
  MISC_FEATURE (10)..(10): Xaa is Phe, Ile, Leu or Val
  MISC_FEATURE (14)..(14): Xaa is Phe, Ile, Leu, Met or Val
  MISC_FEATURE (22)..(22): Xaa is Phe, Ile, Leu or Val
  MISC_FEATURE (26)..(26): Xaa is Ala, Ile, Pro or Val
  MISC_FEATURE (29)..(29): Xaa is Ala, Asp, Gly, Asn or Ser
  MISC_FEATURE (30)..(30): Xaa is Ile, Leu, Met or Val
SXGXXXXXXXXXXXXXXXXXLXLDEXXXXXD

SEQ ID NO: 268 - protein, 25 aa, Artificial Sequence
  consensus
  MISC_FEATURE (2)..(6): Xaa is any or no amino acid
  MISC_FEATURE (8)..(24): Xaa in positions 8, 10-11, 13-18, 20-21, 23-24 is any amino acid
  MISC_FEATURE (9)..(9): Xaa is Phe, Ile, Leu or Met
  MISC_FEATURE (12)..(12): Xaa is Ala, Ile, Leu or Val
  MISC_FEATURE (19)..(19): Xaa is Ile, Leu or Val
  MISC_FEATURE (22)..(22): Xaa is Phe, Ile, Leu, Met or Val
TXXXXXHXXXXXXXXXXXXXXXXXG

SEQ ID NO: 269 - DNA, 1096 bp, Brassica napus
  CDS (63)..(914)
aacacacttacacacacaaactctctctctttctctctatctgaccgtttgatcctcaaaaaatggcggagaaagatgcgatggccagaagcgacggtgcgattagggttagcggaatgcagttttcttacgatgtccaagatcctatcttcttcgatttcagcctccatctccccgccggatctcgctgcctcttggttggtgctaatggatctggcaagacgactttattgaagattttggcaggaaagcatatggttggagggaagaacattgtgcaagtcctgaatcgctctgcttttcacgacacagaccttgtctgtagtggtgacttgtcttaccttggaggctcatggagcaaaaccgctggttccgctggtgagattcctctccagggagatttctcagcagagcatatgatatttggagttgaagggattgatcctgtgagaagagagaaactgattgatcttcttgatatcaatcttaagtggcgtatgcataaggtttctgatgggcagagacgccgagtgcagatatgcatgggtcttttacatccattcaaggtattattactggacgaggtcactgtggacctagacgttgttgctaggatggatttgttggaattctttaaagaagaatgtgaacagagaggagctactattgtatatgcaactcatatttttgacggactagagacatgggctagtcatttggcctatatccatggaggagagctgaagctctctgctaaactgaaggagatcaaggatttagaaacatccccaaatctgctctctgtggttgaaaattggcttcggtctgaaaccaaagtggagaagaagactaagaagaaacctgttgccacgtctccatttatgtcatctagacaaatggcgtattaccgatgaatctcagcatctttgagacatcagtaagaataagagctttttcacatttgcaattgtttttctttaatattttgtttgctttagtactctcattccaaatataagtttaaactacgatgtcacaaacttaggtttggatatagatcagataatacatgcattcgcaataaaaaaaaaaaaaa

SEQ ID NO: 270 - protein, 283 aa, Brassica napus
MAEKDAMARSDGAIRVSGMQFSYDVQDPIFFDFSLHLPAGSRCLLVGANGSGKTTLLKILAGKHMVGGKNIVQVLNRSAFHDTDLVCSGDLSYLGGSWSKTAGSAGEIPLQGDFSAEHMIFGVEGIDPVRREKLIDLLDINLKWRMHKVSDGQRRRVQICMGLLHPFKVLLLDEVTVDLDVVARMDLLEFFKEECEQRGATIVYATHIFDGLETWASHLAYIHGGELKLSAKLKEIKDLETSPNLLSVVENWLRSETKVEKKTKKKPVATSPFMSSRQMAYYR

SEQ ID NO: 271 - DNA, 1096 bp, Brassica napus
  CDS (12)..(887)
cggagaaacaaatggcagcgaaagatcaggcgacgaccagtgatgatgccattagagttagcggtatggagttttcttatgaagcggaggatcctatattcttcgatttcaacctcgatcttccagcaggatctcgctgccttcttgttggcgccaatggatctggcaagacaaccttgttgaagattctggctggaaagcatatggttggaggaaagaacgttgtacaagttctaagccgctctgctttccatgatactcaacttgtttgcagtggtgacttgtcttaccttggaggatcttggagtaaaaccattggttcggctggtgaggttcctcttcagggagacttttcagcagaacatatgatatttggagttgaaggaatcgatccggtgagaagagataaactgattgatcttcttgacatcaaccttcagtggcgtatgcataaggtttctgatgggcaaaaacgccgagttcagatatgcatgggactcttacatccattcaaggtgttgttacttgacgaggtaactgttgaccttgatgttgttgcaaggatggatttgctggaattcttcaaagaagaatgtgatcagagaggagctacaattgtatatgcaactcatatattcgacgggctagagacatgggctacacatttggcttacattcagaacggtgagctgaatcgttcatcaaaaatggcagacatcagcgagatgaaaacttcacccaacctcctctccgtggtagaatcttggctccgttctgaaaccaaaatttacaagaaaaagaagaaggagcctgtggcagcatggaaaccaactccatttgataactctccttttaggtcatctagacacatggcttactaccgatgattggtaattacggatggatcatatgtatgagtattagtaagaataaggccactagggacaagttcacattgtgtgtgtgttgttgagctgttatacactattgtgcacattgaagaatatacaacacaatatgcctattgttctgtcacataacttttttttatattgactgagttttatagctgttaaaaaaagaaaaaaaaaaaaaa

SEQ ID NO: 272 - protein, 291 aa, Brassica napus
MAAKDQATTSDDAIRVSGMEFSYEAEDPIFFDFNLDLPAGSRCLLVGANGSGKTTLLKILAGKHMVGGKNVVQVLSRSAFHDTQLVCSGDLSYLGGSWSKTIGSAGEVPLQGDFSAEHMIFGVEGIDPVRRDKLIDLLDINLQWRMHKVSDGQKRRVQICMGLLHPFKVLLLDEVTVDLDVVARMDLLEFFKEECDQRGATIVYATHIFDGLETWATHLAYIQNGELNRSSKMADISEMKTSPNLLSVVESWLRSETKIYKKKKKEPVAAWKPTPFDNSPFRSSRHMAYYR

SEQ ID NO: 273 - DNA, 1145 bp, Glycine max
  CDS (177)..(1067)
gaattcatgtcgtttgacacacacgccgtgcgttttgaaagttccataccattaagcaccgaaaagcggtgggtggaagtggcgacgtggttggtggtctcttcacacattttgttggttggtttcaactaccgcgtgcactgacgtgtaacttttctactggctcccaagagaatatgaatagctccctctctggcaatggtggttccacaacaatggcggcagaaaacgaagattcctgcggaatccgcgtcaccggcatgcaattctcctacgacgtgcagcaaccgccgctcttcctcgacttcaacctcaacgtctctcccggatcccgctgcctcctcgtcggtgccaatggatccggaaagacgactttgctgaagattctggcggggaagcacatggttggaggaagagacgttgtgcgcgtcttgagtggttccgcttttcacgacactcagctcgtttgtagcggagatctcgcttatttgggcggatcttggagcaaaaacgttggctccgctggagaaattccgctccaaggagacttctctgctgaacatatgatctttggagttgagggtgctgatccagaaaggagagataagttaattgagctgcttgatattgatctacagtggcgaatgcataaggtatctgatgggcagcggcgtcgagtgcaaatctgtcttggtcttcttcatccgtacaaggttctcttgctggatgaggttactgtggatctggatgttgttactcggatggatttattggacttctttaaggaagaatgtgaacagagagaagctataatcgtatatgcaactcatatttttgatggactggagacatgggcaactcatttggcatacatacaagatggtgaactgagaagagcagaaaaaatatcaaatgttaaagagttgaaatcttcaactaatctgctgtctgttgttgaggcctggcttcgcgctgaaacaaagcttgaaaagaagaaccctgtccaaaagacttctgttgccagttctcctttcttttcatctagacacatggcatactatagatagtgtttttgacacagatttcttatgaaaataatttgggtggcaaatacaagtaattcattctttcaaaaaaaaaaaaaa

SEQ ID NO: 274 - protein, 296 aa, Glycine max
MNSSLSGNGGSTTMAAENEDSCGIRVTGMQFSYDVQQPPLFLDFNLNVSPGSRCLLVGANGSGKTTLLKILAGKHMVGGRDVVRVLSGSAFHDTQLVCSGDLAYLGGSWSKNVGSAGEIPLQGDFSAEHMIFGVEGADPERRDKLIELLDIDLQWRMHKVSDGQRRRVQICLGLLHPYKVLLLDEVTVDLDVVTRMDLLDFFKEECEQREAIIVYATHIFDGLETWATHLAYIQDGELRRAEKISNVKELKSSTNLLSVVEAWLRAETKLEKKNPVQKTSVASSPFFSSRHMAYYR

SEQ ID NO: 275 - DNA, 1206 bp, Brassica napus
  CDS (62)..(1036)
caaacgtctgaagaaaagtataaaacgagacagaagagagaacgaagaagtagtagtaaagatggaagaggagaagcgagatacaacgatggagatctccggattacgattcacgtatccaggaatcgatggccatccacctccgggatcgaaaccgctcatcgaggatttctctctgaagctcaactcgagcgaacggtgtctcctcgtcggatctaacggcgccgggaagacgacgatactgaagatattgggagggaaacatatggtggagccgcacatggttagggttcttggtcgatcggcgtttcacgacaccggattgacatcttcgggtgatctctgctatctcggcggcgagtggaggcgtgacgtggcatttgcaggatttgaagtgccgatacaaatggatatatcggcagagaagatgatattcggagtggctggtattgatccaaagagaagagatgaattgatcaaggtgttggatatcgatatctcatggagattgcacaaggtctctgatggccaaagaagacgcgtccagatctgtatgggactcctcaagcctttcaaggttctccttttggatgaaatcactgttgatcttgacgttctcgccagagccgaccttttggcatttctgagaaaggaatgccaagaacgaggagctaccattatctacgccactcatattttcgatggccttgaggattggcctacacacattgtgtatgtagcaaacgggaagttacagttagcaatgccaatggagaaagtgaaggaaacaagcaagaagtcattgatgagaacagttgagagttggttgaggaaagaaagagacgaggagaggaaaacaaggaaagaaaggaaagccaatggccttcctgagttcgaaacacgtcctcaagaaagccgtgtcaccggtgatcctgctcggatgctcaacaatggctgggctgccgggaggcttcactctaccattgcaggcggtgaagatcatttcgtcttaagctcaaacagggttctcagataagcatgcatgcgagagactccactggagcaaaaaggtcataataatattttctgtatttttttttttctcttttttaaccacgaataatactttttttttctgtaacccgtttgagtgtttgttattttgagatatgaattttatattattttctgcaaaaaaaaaaaaaa

SEQ ID NO: 276 - protein, 324 aa, Brassica napus
MEEEKRDTTMEISGLRFTYPGIDGHPPPGSKPLIEDFSLKLNSSERCLLVGSNGAGKTTILKILGGKHMVEPHMVRVLGRSAFHDTGLTSSGDLCYLGGEWRRDVAFAGFEVPIQMDISAEKMIFGVAGIDPKRRDELIKVLDIDISWRLHKVSDGQRRRVQICMGLLKPFKVLLLDEITVDLDVLARADLLAFLRKECQERGATIIYATHIFDGLEDWPTHIVYVANGKLQLAMPMEKVKETSKKSLMRTVESWLRKERDEERKTRKERKANGLPEFETRPQESRVTGDPARMLNNGWAAGRLHSTIAGGEDHFVLSSNRVLR

SEQ ID NO: 277 - DNA, 1106 bp, Triticum aestivum
  CDS (77)..(952)
tcgcaccaactcccctgaagcctgaacggagcggcggagaggaaggggagagatcacccgccggcggcgaggggagatggccggaggcgaggaagggtggaggaggagcggcatcgaggtgagcaccctgcagttcggctacgacggggaggcgccgctcttcgcgcgcttcaacctccgcgtcgcccccggctcgcgctgcctcctcgtcggcgccaacggatccggcaagaccactctcttaaagattcttgcaggaaaacatatggttggaggaaaggatgttgtccgtgttcttaatggttctgcttttcatgacacacagtttgtgtgcagtggtgacctttcctacttgggtggttcgtggagtcggaatgtcagttcagttggtgatgttccactacaaggcgatttctctgctgagcacatgatatttggagttgatggggttgatcctgttaggcgagagcagctgattgatctactggatattgatctgcaatggcgcatgcataaagtttcagatggacagcgccgcagggtacaaatttgcatgggtcttcttcatccatacaaggtactcttactcgatgagatcaccgtggatctcgatgtcgtgaccaggatggatctcctcgacttcttcaaggaagagtgcgagcagagggaagccacgatcgtctacgccacgcacatattcgacggcctggagacatgggcgaccgacatcgcgtacatccaggagggcgagctgaaaaagtcggcgaaatactcggacatcgaagagctcaagacggccaagaacctgctgtcggtcgtggagtcatggctgaagtccgagaccaaactcccgaagaaagagcccgcgcgcgtcgagagccagcccaggcgcccctccccgttcgacgcctcccctttccgagcgtcgcgccacatggcctactaccgatgatgatcgtgtaaaacctctacacccattccggtgtcatacaactctggagtctgtatctttctttttcctgttcctcatgcatccctgtatacggcaatgtatctatctgaagaacaaacaagtcgagcttaattaccccaaaaaaaaaaaaaaa

SEQ ID NO: 278 - protein, 291 aa, Triticum aestivum
MAGGEEGWRRSGIEVSTLQFGYDGEAPLFARFNLRVAPGSRCLLVGANGSGKTTLLKILAGKHMVGGKDVVRVLNGSAFHDTQFVCSGDLSYLGGSWSRNVSSVGDVPLQGDFSAEHMIFGVDGVDPVRREQLIDLLDIDLQWRMHKVSDGQRRRVQICMGLLHPYKVLLLDEITVDLDVVTRMDLLDFFKEECEQREATIVYATHIFDGLETWATDIAYIQEGELKKSAKYSDIEELKTAKNLLSVVESWLKSETKLPKKEPARVESQPRRPSPFDASPFRASRHMAYYR

SEQ ID NO: 279 - DNA, 1218 bp, Linum usitatissimum
  CDS (49)..(1053)
gaaaatagaacctttcctacctattcagcagcggtgaagaagggggtaatggcgatcatggatcagtccccacgacagccaacgatcgaaatcaatggcctcaggttcacatatccaggaatcgacggccaccctccgcctggttccaaacccctcatcgaagatctgtcgctcactctcaatgccggcgaccgatgcctcctcgtcggatccaatggcgcagggaagacgacgatactgaaaataatgggagggaagcatatggtggagtctcacatggttcgggtgttgggtaggtctgctttccacgacactgccttgtctgcttccggcgatctttcctatctcggaggagagtggcggagggatgttgcttttgctgggtttgaggtcccaattcaaatggatatttctgcagagaagatgttgtttggtgtggctgggatcgacactcagagaagagatgaactgatcaaggtattggacattgatctgtcatggagaatgcacaaagtttctgatggtcagaggagaagagtgcagatctgtatgggcctcctgagaccattcaaggttcttttactggatgagataacagttgatctggatgtgctagcccgggcggatcttctgacattcctaaggaaggaatgcgaagaaagaggtgccactatcatctatgccactcacatatttgatgggttagaggagtggcctacacatatggtgtacgtagctggtgggaagttgcaattagcaatgccaatgtcaaaaatcaagcagattagtgatctgtctctgatgagaacagttgaaggttggttgaggaaagagagggacgaggagaggaagaggaggaaagagaggaaagctaaaggactgccggagtttgaaaaccagcaggttgagggaagtcgggtagttggtggagatccagctcgttctgcagcagttaaaatgacaaacaatggatgggcagctgggaggctgcattccactattgcaggggaagacaacttcaacctcagctccaatagagttatgaggcagtgaggaacccccaattgggtctacccagatatggttttttctctctttctatttgtataacaagggatcttgattcttcatttcaagtatagtcctgaatgttcagtgttttttttaaatatccctaagattctaattttatctatttcatctaaaaaaaaaaaaaaa

SEQ ID NO: 280 - protein, 334 aa, Linum usitatissimum
MAIMDQSPRQPTIEINGLRFTYPGIDGHPPPGSKPLIEDLSLTLNAGDRCLLVGSNGAGKTTILKIMGGKHMVESHMVRVLGRSAFHDTALSASGDLSYLGGEWRRDVAFAGFEVPIQMDISAEKMLFGVAGIDTQRRDELIKVLDIDLSWRMHKVSDGQRRRVQICMGLLRPFKVLLLDEITVDLDVLARADLLTFLRKECEERGATIIYATHIFDGLEEWPTHMVYVAGGKLQLAMPMSKIKQISDLSLMRTVEGWLRKERDEERKRRKERKAKGLPEFENQQVEGSRVVGGDPARSAAVKMTNNGWAAGRLHSTIAGEDNFNLSSNRVMRQ

SEQ ID NO: 281 - DNA, 1111 bp, Hordeum vulgare
  CDS (76)..(951)
cgttggctcgcaccaactccgctgaagcctgagaggaaggggagagatcacccggcggcggcgaggggaggggagatggccggaggcgaggaagggtggaggaggagcggaatcgaggtcagcaccctgcagttcggctacgacggggaggcgcccctcttcgcgcgcttcaacctccgcgtcgcccccggctcccgctgcctcctcgtcggcgccaacggatccggcaagaccactctcttgaagattcttgcaggaaaacatatggttggagggaaggatgttgttcgtgttcttaatggttctgcttttcatgacacacagttcgtgtgcagtggtgacctttcctacttgggtggttcgtggagtcggactgtcagttcagttggtgatgttccactccaaggcgatttctctgctgagcacatgatatttggagttgatggggttgatcctgttaggcgagacaagctgattgatctactagatattgatctgcaatggcgcatgcataaagtttctgacggacaacgccgcagggtacaaatttgcatgggtcttcttcatccgtacaaggtcctcttactcgatgagatcacggttgatctcgatgtcgtgaccaggatggatctcctcgacttcttcaaggaagagtgcgagcagagagaagccacgatcgtctacgccacccacatattcgacgggctggagacatgggcgaccgacatcgcgtacatccaagagggtgagctgaaaaggtcagcgaaatactcggacatcgaagagctcaagacggccaagaacctgctgtcggtcgtggagtcatggctgaagtccgagaccaagctcccgaagaaagagcccgcgctcgtcgagacccagcccaggcgcccctccccgttcgacgcctcccctttccgggcgtcgcgccacatggcctactaccgatgatgatcgtgtaaaacctctatattccggtcttgtcatacaactctggaatctgtatcttcttcttcttctttctgttcctcgtctctgtatacggcaatgtatctatctaaatctaaataacaaacaagccgagctccattatccgaaaaaaaaaaaaaaa

SEQ ID NO: 282 - protein, 291 aa, Hordeum vulgare
MAGGEEGWRRSGIEVSTLQFGYDGEAPLFARFNLRVAPGSRCLLVGANGSGKTTLLKILAGKHMVGGKDVVRVLNGSAFHDTQFVCSGDLSYLGGSWSRTVSSVGDVPLQGDFSAEHMIFGVDGVDPVRRDKLIDLLDIDLQWRMHKVSDGQRRRVQICMGLLHPYKVLLLDEITVDLDVVTRMDLLDFFKEECEQREATIVYATHIFDGLETWATDIAYIQEGELKRSAKYSDIEELKTAKNLLSVVESWLKSETKLPKKEPALVETQPRRPSPFDASPFRASRHMAYYR

SEQ ID NO: 283 - DNA, 852 bp, Glycine max
  CDS (1)..(852)
atggcggcagaaaacgaagattcctgcggaatccgcgtcaccggcatgcaattctcctacgacgtgcagcaaccgccgctcttcctcgacttcaacctcaacgtctctcccggatcccgctgcctcctcgtcggtgccaatggatccggaaagacgactttgctgaagattctggcggggaagcacatggttggaggaagagacgttgtgcgcgtcttgagtggttccgcttttcacgacactcagctcgtttgtagcggagatctcgcttatttgggcggatcttggagcaaaaacgttggctccgctggagaaattccgctccaaggagacttctttgctgaacatatgatctttggagttgagggtgctgatccagaaaggagagataagttaattgagctgcttgatattgatctacagtggcgaatgcataaggtatctgatgggcagcggcgtcgagtgcaaatctgtcttggtcttcttcatccgtacaaggttctcttgctggatgaggttactgtggatctggatgttgttactcggatggatttattggacttctttaaggaagaatgtgaacagagagaagctataatcgtatatgcaactcatatttttgatggactggagacatgggcaactcatttggcatacatacaagatggtgaactgagaagagcagaaaaaatatcaaatgttaaagagttgaaatcttcaactaatctgctgtctgttgttgaggcctggcttcgcgctgaaacaaagcttgaaaagaagaaccctgtccaaaagacttctgttgccagttctcctttcttttcatctagacacatggcatactatagatag

SEQ ID NO: 284 - protein, 283 aa, Glycine max
MAAENEDSCGIRVTGMQFSYDVQQPPLFLDFNLNVSPGSRCLLVGANGSGKTTLLKILAGKHMVGGRDVVRVLSGSAFHDTQLVCSGDLAYLGGSWSKNVGSAGEIPLQGDFFAEHMIFGVEGADPERRDKLIELLDIDLQWRMHKVSDGQRRRVQICLGLLHPYKVLLLDEVTVDLDVVTRMDLLDFFKEECEQREAIIVYATHIFDGLETWATHLAYIQDGELRRAEKISNVKELKSSTNLLSVVEAWLRAETKLEKKNPVQKTSVASSPFFSSRHMAYYR

SEQ ID NO: 285 - DNA, 888 bp, Zea mays
  CDS (1)..(888)
atggccggcgaagggaatggggatgaagggtggaggcggagcggcatcgaggtcagcgccctgcagttcggctacgacgggcagccgccgctcttcgcgcgcttcaacctctgcgtcgcacccggctcccgctgcctcctcgtcggcgccaacggatcaggcaagaccacactcttgaagattcttgcgggaaagcatatggttggaggaagagatgtggtccgtgtcctcaatggttccgcttttcatgatacacagctagtgtgcaatggtgacctttcgtacttgggtggttcttggagccgtactattggttcagctggggatgttccactgcaaggcgacttctctgctgagcacatgatttttggagttgatggggttgatcctgtcaggcgagagaagctggttgatctgctagacattgatctgcagtggcgcatgcataaagtttcagatgggcagcgccgcagggtgcaaatctgcatgggtcttcttcatccatacaaggtgcttttgctcgatgagatcacggttgatctggacgtggtgaccaggatggacctgcttggtttcttcaaggaagagtgcgagcagagggaagctaccatcgtgtacgccacccatatatttgacggactcgagacgtgggctaccgactttgcgtacatccaagaaggcgagctgagaaggtccgggagatactccgacatcgaggagctaaggagcgccaagaacttgctgtcggtagtcgagtcgtggctgaggtcagagaccaaacttccgaagaaggaacccccaccacgtcctgagacccaggccaggcgttcctcgccgttcgatgcttctcctttccgttcgtcacgccacatggcctactaccgttga

SEQ ID NO: 286 - protein, 295 aa, Zea mays
MAGEGNGDEGWRRSGIEVSALQFGYDGQPPLFARFNLCVAPGSRCLLVGANGSGKTTLLKILAGKHMVGGRDVVRVLNGSAFHDTQLVCNGDLSYLGGSWSRTIGSAGDVPLQGDFSAEHMIFGVDGVDPVRREKLVDLLDIDLQWRMHKVSDGQRRRVQICMGLLHPYKVLLLDEITVDLDVVTRMDLLGFFKEECEQREATIVYATHIFDGLETWATDFAYIQEGELRRSGRYSDIEELRSAKNLLSVVESWLRSETKLPKKEPPPRPETQARRSSPFDASPFRSSRHMAYYR

SEQ ID NO: 287 - DNA, 972 bp, Zea mays
  CDS (1)..(972)
atggcaccaacggttgagatcagccacctcaccttcacctaccccggcatcgacggccgcccgccacccggcgcgccaccgctcatcgaggacgtctgcttctccctcgacgccggccaacgatgcctccttctcggctccaacggcgcaggcaagacgacgatactaaagatactaggcgggaagcacatggtggatccgagcatggtgcgggtcctgggaaggtccgccttccacgacacggcactcacctcctccggcgacctctcctatctcggcggtgagtggagacgcgacgtggcctttgctggctaccaggtgaacattcagatggatatatcggcagagaagatgatttttggtgttgctggtgttgatccaaagaggagagacgagcttatcaagactttagacatcgacctcaccgggcgcatgcacaaggcatcagatggtcagaggagacgtgtccagatttgcatgggacttcttaagtcattcaaggttcttcttcttgatgagatcacagttgatcttgatgttctggcaagatcaaatctgttaacatatcttaaaaaggaatgtgaggaaagaggtgcaacaatcatctatgccacacatatttttgatggtcttgatgattggccaacacacattgtttacattgctcatgggaaactgcaattagcactgcctttggaaaagctgaaagaaatgagtcagttatctctcatgaggactgtggagagctggttgaggaaagaaagaaatgaggacaggaggaggagaaaggagcgaaaggagaaaggcctcccagaattcgacaaggttgtcgagggtagtcgggttataggtgatccagcaaagaacgcagacagagttataaacaacgggtgggcagctggacggcttacctcgacgattgcaggagaggaaaatttcgtcttcagctctaacagcgtacttaggcaatga

SEQ ID NO: 288 - protein, 323 aa, Zea mays
MAPTVEISHLTFTYPGIDGRPPPGAPPLIEDVCFSLDAGQRCLLLGSNGAGKTTILKILGGKHMVDPSMVRVLGRSAFHDTALTSSGDLSYLGGEWRRDVAFAGYQVNIQMDISAEKMIFGVAGVDPKRRDELIKTLDIDLTGRMHKASDGQRRRVQICMGLLKSFKVLLLDEITVDLDVLARSNLLTYLKKECEERGATIIYATHIFDGLDDWPTHIVYIAHGKLQLALPLEKLKEMSQLSLMRTVESWLRKERNEDRRRRKERKEKGLPEFDKVVEGSRVIGDPAKNADRVINNGWAAGRLTSTIAGEENFVFSSNSVLRQ

We claim:

1. A process for the increase in yield of a plant, which comprises reducing or deleting the expression of an oligopeptide transporter protein in a plant, wherein the reducing or deleting comprises:
   a) introducing into a plant a nucleic acid molecule encoding a ribonucleic acid sequence, which is able to form a double-stranded ribonucleic acid molecule, whereby the sense strand of said double-stranded ribonucleic acid molecule has a homology of at least 80% to a nucleic acid sequence encoding the protein of SEQ ID NO: 2 or comprises a fragment of at least 20, 21, 22, 23, 24 or 25 bases of said nucleic acid sequence, and whereby the antisense strand of the double-stranded ribonucleic acid molecule is complementary to said sense strand;
   b) introducing into a plant an antisense nucleic acid molecule, whereby the antisense nucleic acid molecule is antisense to the full length of the transcribed mRNA of a protein encoded by a nucleic acid sequence selected from the group consisting of
      i) a nucleic acid sequence encoding the polypeptide of SEQ ID NO: 2;
      ii) the nucleic acid sequence of SEQ ID NO: 1; and
      iii) a nucleic acid sequence encoding a polypeptide comprising an amino acid sequence having at least 80% identity to the amino acid sequence of SEQ ID NO: 2, having the biological activity of the OPT oligopeptide transporter protein that is SEQ ID NO: 2, and comprising the sequence of SEQ ID NO: 88, SEQ ID NO: 89, and SEQ ID NO: 90;
   c) introducing into a plant a ribozyme which specifically cleaves a nucleic acid molecule conferring expression of a protein having the biological activity of a protein encoded by a nucleic acid sequence selected from the group consisting of
      i) a nucleic acid sequence encoding the polypeptide of SEQ ID NO: 2;
      ii) the nucleic acid sequence of SEQ ID NO: 1; and
      iii) a nucleic acid sequence encoding a polypeptide comprising an amino acid sequence having at least 80% identity to the amino acid sequence of SEQ ID NO: 2, having the biological activity of the OPT oligopeptide transporter protein that is SEQ ID NO: 2, and comprising the sequence of SEQ ID NO: 88, SEQ ID NO: 89, and SEQ ID NO: 90;
   d) introducing into a plant the antisense nucleic acid molecule characterized in (b) and the ribozyme characterized in (c);
   e) introducing into a plant a sense nucleic acid molecule conferring the expression of a nucleic acid sequence comprising
      i) the nucleic acid sequence of SEQ ID NO:1;
      ii) a nucleic acid sequence encoding the polypeptide of SEQ ID NO: 2; or
      iii) a nucleic acid sequence encoding a polypeptide comprising an amino acid sequence having at least 80% identity to the amino acid sequence of SEQ ID NO: 2, having the biological activity of the OPT oligopeptide transporter protein that is SEQ ID NO: 2, and comprising the sequence of SEQ ID NO: 88, SEQ ID NO: 89, and SEQ ID NO: 90;
      for inducing co-suppression of an endogenous oligopeptide transporter protein; or
   f) introducing into a plant an expression construct conferring the expression of any one of (a) to (e);
   and expressing said nucleic acid molecule, wherein said expression results in increased plant yield.

2. The process of claim 1, wherein the plant is selected from the group consisting of Anacardiaceae, Asteraceae, Apiaceae, Betulaceae, Boraginaceae, Brassicaceae, Bromeliaceae, Caricaceae, Cannabaceae, Convolvulaceae, Chenopodiaceae, Cucurbitaceae, Elaeagnaceae, Ericaceae, Euphorbiaceae, Fabaceae, Geraniaceae, Gramineae, Juglandaceae, Lauraceae, Leguminosae, Linaceae, perennial grass, a fodder crop, a vegetable, and an ornamental.

3. The process of claim 1, wherein the nucleic acid sequence of b) iii), c) iii), and e) iii) encodes a polypeptide comprising an amino acid sequence having at least 90% identity to the amino acid sequence of SEQ ID NO: 2, has the biological activity of the OPT oligopeptide transporter protein that is SEQ ID NO: 2, and comprises the sequence of SEQ ID NO: 88, SEQ ID NO: 89, and SEQ ID NO: 90.

4. The process of claim 1, wherein the nucleic acid sequence of b) iii), c) iii), and e) iii) encodes a polypeptide comprising an amino acid sequence having at least 95% identity to the amino acid sequence of SEQ ID NO: 2, and has the biological activity of the OPT oligopeptide transporter protein that is SEQ ID NO: 2, and comprises the sequence of SEQ ID NO: 88, SEQ ID NO: 89, and SEQ ID NO: 90.

5. The process of claim 1, wherein the plant is selected from the group consisting of maize, soya, canola, wheat, barley, triticale, rice, linseed, sunflower, potato, and *Arabidopsis*.

6. The process of claim 1, wherein the reducing or deleting comprises introducing into a plant a nucleic acid molecule encoding a ribonucleic acid sequence, which is able to form a double-stranded ribonucleic acid molecule, whereby the sense strand of said double-stranded ribonucleic acid molecule has a homology of at least 80% to a nucleic acid sequence encoding the protein of SEQ ID NO: 2 or comprises a fragment of at least 20, 21, 22, 23, 24 or 25 bases of said nucleic acid sequence, and whereby the antisense strand of the double-stranded ribonucleic acid molecule is complementary to said sense strand.

7. The process of claim 1, wherein the reducing or deleting comprises introducing into a plant an antisense nucleic acid molecule, whereby the antisense nucleic acid molecule is antisense to the full length of the transcribed mRNA of a protein encoded by a nucleic acid sequence selected from the group consisting of
   i) a nucleic acid sequence encoding the polypeptide of SEQ ID NO: 2;
   ii) the nucleic acid sequence of SEQ ID NO: 1; and
   iii) a nucleic acid sequence encoding a polypeptide comprising an amino acid sequence having at least 80% identity to the amino acid sequence of SEQ ID NO: 2, having the biological activity of the OPT oligopeptide transporter protein that is SEQ ID NO: 2, and comprising the sequence of SEQ ID NO: 88, SEQ ID NO: 89, and SEQ ID NO: 90.

8. The process of claim 1, wherein the reducing or deleting comprises introducing into a plant a ribozyme which specifically cleaves a nucleic acid molecule conferring expression of a protein having the biological activity of a protein encoded by a nucleic acid sequence selected from the group consisting of
   i) a nucleic acid sequence encoding the polypeptide of SEQ ID NO: 2;
   ii) the nucleic acid sequence of SEQ ID NO: 1; and
   iii) a nucleic acid sequence encoding a polypeptide comprising an amino acid sequence having at least 80% identity to the amino acid sequence of SEQ ID NO: 2, having the biological activity of the OPT oligopeptide transporter protein that is SEQ ID NO: 2, and comprising the sequence of SEQ ID NO: 88, SEQ ID NO: 89, and SEQ ID NO: 90.

9. The process of claim 1, wherein the reducing or deleting comprises introducing into a plant the antisense nucleic acid molecule characterized in (b) and the ribozyme characterized in (c).

10. The process of claim 1, wherein the reducing or deleting comprises introducing into a plant a sense nucleic acid molecule conferring the expression of a nucleic acid sequence comprising
   i) the nucleic acid sequence of SEQ ID NO:1;
   ii) a nucleic acid sequence encoding the polypeptide of SEQ ID NO: 2; or
   iii) a nucleic acid sequence encoding a polypeptide comprising an amino acid sequence having at least 80% identity to the amino acid sequence of SEQ ID NO: 2, having the biological activity of the OPT oligopeptide transporter protein that is SEQ ID NO: 2, and comprising the sequence of SEQ ID NO: 88, SEQ ID NO: 89, and SEQ ID NO: 90, for inducing co-suppression of an endogenous oligopeptide transporter protein.

11. The process of claim 1, wherein the nucleic acid sequence comprises SEQ ID NO: 1, or wherein the nucleic acid sequence encodes a polypeptide comprising the amino acid sequence of SEQ ID NO: 2.

* * * * *